US012565661B2

(12) United States Patent
Dale et al.

(10) Patent No.: US 12,565,661 B2
(45) Date of Patent: Mar. 3, 2026

(54) COMPOSITIONS AND METHODS FOR WEED CONTROL

(71) Applicants: Syngenta Crop Protection AG, Basel (CH); Syngenta Crop Protection, LLC, Research Triangle Park, NC (US)

(72) Inventors: Richard Dale, Bracknell (GB); Jeffrey Steven Wailes, Bracknell (GB); Anne Mary Seville, Bracknell (GB); Christian Guy Noble, Bracknell (GB); Anthea Karin Batchelor, Bracknell (GB); Jillian Leslie Goodwin, Bracknell (GB); Rachael Elizabeth Blain, Bracknell (GB); Marta Andreia Horta Simoes, Bracknell (GB); David Brocklehurst, Bracknell (GB); Michael Phillip Langford, Bracknell (GB)

(73) Assignee: Syngenta Crop Protection AG, Basel (CH)

( * ) Notice: Subject to any disclaimer, the term of this patent is extended or adjusted under 35 U.S.C. 154(b) by 471 days.

(21) Appl. No.: 17/608,208

(22) PCT Filed: May 19, 2020

(86) PCT No.: PCT/US2020/033556
§ 371 (c)(1),
(2) Date: Nov. 2, 2021

(87) PCT Pub. No.: WO2020/236790
PCT Pub. Date: Nov. 26, 2020

(65) Prior Publication Data

US 2022/0235368 A1 Jul. 28, 2022

Related U.S. Application Data

(60) Provisional application No. 62/850,248, filed on May 20, 2019.

(51) Int. Cl.
*C12N 15/82* (2006.01)
*C12N 9/10* (2006.01)

(52) U.S. Cl.
CPC ....... *C12N 15/8274* (2013.01); *C12N 9/1085* (2013.01)

(58) Field of Classification Search
None
See application file for complete search history.

(56) References Cited

U.S. PATENT DOCUMENTS

| | | | |
|---|---|---|---|
| 2006/0150283 A1 | 7/2006 | Alexandrov et al. | |
| 2017/0114361 A1 | 4/2017 | Gao et al. | |

FOREIGN PATENT DOCUMENTS

| | | | |
|---|---|---|---|
| WO | 2010/046434 A1 | 4/2010 | |
| WO | 2015/108779 A1 | 7/2015 | |
| WO | 2018/204164 A1 | 11/2018 | |

OTHER PUBLICATIONS

Hirooka et al (2005, Biosci. Biotechnol. Biochem. 69:592-601).*
EFSA Scientific Report (2008, 149:1-80).*
GenBank XP_044418221, 2021, https://www.ncbi.nlm.nih.gov/protein/XP_044418221.1.*
GenBank XM_044562286 (2021, https://www.ncbi.nlm.nih.gov/nuccore/XM_044562286.1).*
Dayan, 2019, Plants 8:341; doi: 10.3390/plants8090341.*
Kahlau et al (2020, Pest Manag. Sci.; 76: 3377-3388, DOI 10.1002/ps.5781).*
Theologis, A. et al., "Sequence and analysis of chromosome 1 of the plant *Arabidopsis thaliana*," Dec. 14, 2000, Nature; vol. 408, No. 6814, pp. 1-3.
Ksas, B. et al., "Plant tolerance to excess light energy and photooxidative damage relies on platoquinone biosynthesis," Jun. 3, 2015, Scientific Reports; vol. 5, No. 10919, pp. 1-16.
Kahlau, S. et al., "Aclonifen targets solanesyl diphosphate synthase, representing a novel mode of action for herbicides," Feb. 7, 2020, Pest Management Science (abstract only).
Supplemental Partial EP Search Report for European Application No. 2080367.4, mailed Jun. 1, 2023.
Shino Mamiko et al: "Action mechanism of bleaching herbicide cyclopyrimorate, a novel homogentisate solanesyltransferase inhibitor"; Journal of Pesticide Science, vol. 43(4), Nov. 20, 2018; ISSN: 1348-589X.
Kahlau Sabine et al: "Aclonifen targets solanesyl diphosphate synthase, representing a novel mode of action for herbicides"; Pest Management Science, vol. 76(10), Feb. 27, 2020, pp. 3377-3388; ISSN: 1526-498X.
Extended European Search Report for European Application No. 20809367.4, mailed Sep. 11, 2023, 16 Pages.
International Preliminary Report on Patentability for International Application No. PCT/US2020/033556, mailed Dec. 2, 2021, 11 Pages.

(Continued)

*Primary Examiner* — Anne Kubelik
(74) *Attorney, Agent, or Firm* — Destiny Davenport

(57) ABSTRACT

The present disclosure relates to, inter alia, methods and compositions for weed control, for example, a method of selectively controlling weeds at a locus comprising crop plants and weeds by applying to the locus a weed controlling amount of a pesticide composition comprising a SDPS-inhibiting herbicide, wherein the crop plants are modified such that they comprise a SDPS which provides the crop plant with tolerance against the SPDS-inhibiting herbicide. Compositions also include, inter alia, recombinant polynucleotides suitable for use in the methods.

14 Claims, 3 Drawing Sheets

Specification includes a Sequence Listing.

(56) References Cited

OTHER PUBLICATIONS

International Search Report and Written Opinion for International Application No. PCT/US2020/033556, mailed Dec. 21, 2020, 15 Pages.
Luo J., et al., "Identification and Subcellular Localization of Two Solanesyl Diphosphate Synthases From *Arabidopsis thaliana*," UNIPROTKB, Accession No. Q76FS5, May 8, 2019, XP093076597.
Office Action for Canadian Patent Application No. 20203136075, mailed Jan. 9, 2025, 4 pages.
Schnable, et al., "Solanesyl Diphosphate Synthase 2 Chloroplastic," NCBI, Feb. 9, 2018, pp. 1-3.
Theologis, et al., "Solanesyl Diphosphate Synthase 2," NCBI, Jan. 22, 2014, pp. 1-5.

* cited by examiner

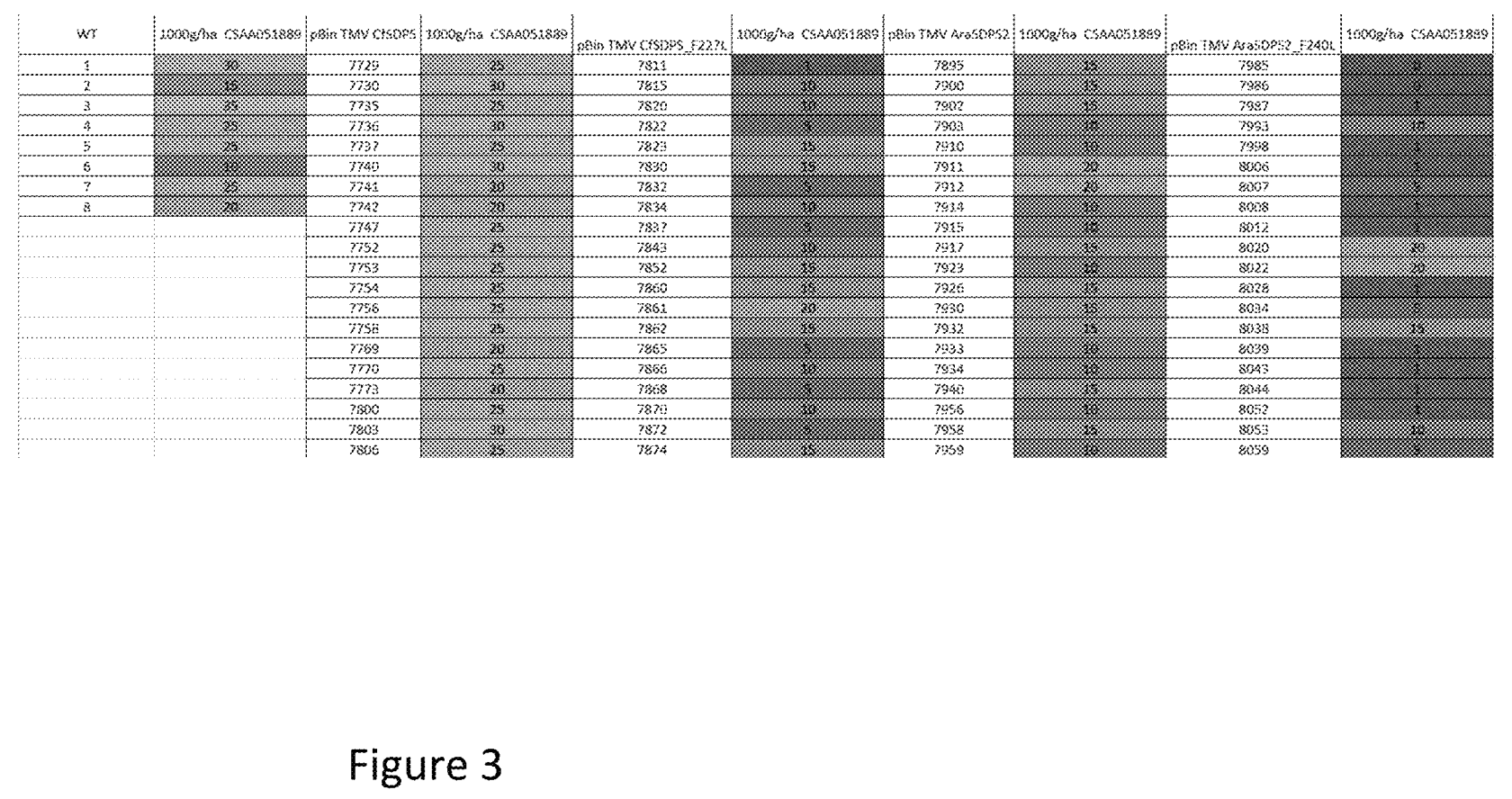

| WT | 1000g/ha CSAA051889 | pBin TMV CfSDPS | 1000g/ha CSAA051889 | pBin TMV CfSDPS_F227L | 1000g/ha CSAA051889 | pBin TMV AraSDPS2 | 1000g/ha CSAA051889 | pBin TMV AraSDPS2_F240L | 1000g/ha CSAA051889 |
|---|---|---|---|---|---|---|---|---|---|
| 1 | 20 | 7729 | 25 | 7811 | 1 | 7895 | 15 | 7985 | 1 |
| 2 | 15 | 7730 | 30 | 7815 | 10 | 7900 | 15 | 7986 | 1 |
| 3 | 25 | 7735 | 25 | 7820 | 10 | 7902 | 15 | 7987 | 1 |
| 4 | 25 | 7736 | 30 | 7822 | 5 | 7903 | 10 | 7993 | 10 |
| 5 | 25 | 7737 | 25 | 7823 | 15 | 7910 | 10 | 7998 | 1 |
| 6 | 10 | 7740 | 30 | 7830 | 15 | 7911 | 20 | 8006 | 1 |
| 7 | 25 | 7741 | 30 | 7832 | 5 | 7912 | 20 | 8007 | 1 |
| 8 | 20 | 7742 | 20 | 7834 | 10 | 7914 | 10 | 8008 | 1 |
| | | 7747 | 25 | 7837 | 5 | 7915 | 10 | 8012 | 1 |
| | | 7752 | 25 | 7843 | 10 | 7917 | 15 | 8020 | 30 |
| | | 7753 | 25 | 7852 | 15 | 7923 | 10 | 8022 | 20 |
| | | 7754 | 35 | 7860 | 15 | 7926 | 15 | 8028 | 1 |
| | | 7756 | 25 | 7861 | 20 | 7930 | 15 | 8034 | 5 |
| | | 7758 | 25 | 7862 | 15 | 7932 | 15 | 8038 | 15 |
| | | 7769 | 20 | 7865 | 5 | 7933 | 10 | 8039 | 1 |
| | | 7770 | 25 | 7866 | 10 | 7934 | 10 | 8043 | 1 |
| | | 7773 | 30 | 7868 | 5 | 7940 | 15 | 8044 | 1 |
| | | 7800 | 25 | 7870 | 10 | 7956 | 10 | 8052 | 1 |
| | | 7803 | 30 | 7872 | 5 | 7958 | 15 | 8053 | 10 |
| | | 7806 | 25 | 7874 | 15 | 7959 | 10 | 8059 | 5 |

Figure 3

COMPOSITIONS AND METHODS FOR WEED CONTROL

RELATED APPLICATION INFORMATION

This application is a 371 of International Application No. PCT/US2020/033556, filed 19 May 2020, which claims priority to U.S. Application No. 62/850,248, filed 20 May 2019, the contents of which are incorporated herein by reference herein.

SEQUENCE LISTING

This application is accompanied by an updated sequence listing entitled 81880-WO-updated-REG-ORG-P-1_SEQ LIST_ST25.txt, created Jun. 24, 2024, which is approximately 1533 kilobytes in size. This sequence listing is incorporated herein by reference in its entirety. This sequence listing is submitted herewith via EFS-Web, and is in compliance with 37 C.F.R. § 1.824(a)(2)-(6) and (b).

FIELD

The instant disclosure relates generally to compositions and methods for controlling weeds in crops, including to compositions and methods to create herbicide tolerance to Solanesyl Diphosphate Synthase (SDPS) inhibiting herbicides.

BACKGROUND

The use of herbicide tolerance transgenes to engineer crops to become herbicide-tolerant and thereby to extend the use of certain herbicides to further crops is well reported. Herbicide-tolerance can be conferred simply by overexpression of a gene encoding the herbicide target protein and/or through expression of transgenes encoding an altered and thereby herbicide-insensitive target site (e.g a glyphosate insensitive 5-enolpyruvyl shikimate-3-phosphate synthase in the case of glyphosate tolerance) and/or the expression of an enzyme that metabolises the herbicide to an inactive form (e.g. phosphinothricin N-acetyl transferase as in the case of glufosinate tolerance). Similarly, in situ mutagenesis (directed or otherwise) has been used to mutate, for example, acetolactate synthase (ALS) or Acetyl CoA carboxylase (ACCase) herbicide target genes in order to create mutant herbicide-tolerant crop lines. Aside from the early examples of tolerance to the non-selective herbicides glyphosate and glufosinate, there is now extensive reports of transgenes and methods to confer herbicide tolerance to other herbicides for example, those which act by inhibiting 4-hydroxyphenylpyruvate dioxygenase (HPPD), protoporphyrinogen oxidase (PPO) and also to several auxin type herbicides, notably dicamba and 2,4 D.

Still applicant desires additional compositions and methods to confer herbicide tolerance to other herbicides, for example, to provide growers with additional application flexibility as well as to provide additional resistance management options. Mom specifically applicant desires compositions and methods to confer herbicide tolerance to herbicidal compounds that exert their herbicidal effect via inhibition of Solanesyl Diphosphate Synthase.

In higher plants. Solanesyl Diphosphate Synthase enzymes are involved in the biosynthesis of ubiquinone and plastoquinone. The enzymes function to provide Solanesyl Diphosphate which acts as the precursor to the sidechains of both ubiquinone and plastoquinone. In *Arabidopsis*, SDPS1 has been characterised as the enzyme responsible for the production of precursor for the ubiquinone sidechain while the plastid targeted SDPS2 is responsible for the production of precursor for the plastoquinone sidechain. The plastoquinone biosynthesis pathway has been previously targeted by herbicides which inhibit the HPPD or HST enzymes to give a characteristic bleached phenotype. The present disclosure is based, inter alia. upon applicant's work related to certain herbicidal compounds that exert their herbicidal effect via inhibition of Solanesyl Diphosphate Synthase.

SUMMARY

The present disclosure thus relates to, inter alia, compositions and methods for selectively controlling weeds at a locus. The disclosure further relates to recombinant DNA technology, and in particular to the production of transgenic plants which exhibit substantial resistance or substantial tolerance to herbicides when compared with non-transgenic like plants. The disclosure further relates to DNA editing technology, and in particular to the production of DN A edited plants which exhibit substantial resistance or substantial tolerance to herbicides when compared with non-transgenic like plants.

Tolerance to Solanesyl Diphosphate Synthase (SDPS) inhibiting herbicides in plants has not been reported as it has not previously been recognised as the target site for certain classes of herbicidal compounds. Transgenic plants overexpressing a Solanesyl Diphosphate Synthase gene or expressing or overexpressing a variant thereof are tolerant of the described herbicides. The present invention thus provides, inter alia. an opportunity to utilise Solanesyl Diphosphate Synthase-inhibiting herbicides in a broader agricultural context.

In one example, the disclosure includes methods of selectively controlling weeds at a locus comprising crop plants and weeds. This method comprises applying to the locus a weed controlling amount of a pesticide composition comprising a Solanesyl Diphosphate Synthase-inhibiting herbicide. wherein the crop plants are modified to comprise a Solanesyl Diphosphate Synthase that provides the crop plant with tolerance against the Solanesyl Diphosphate Synthase-inhibiting herbicide.

The crops plants may be modified with a recombinant polynucleotide which provides the Solanesyl Diphosphate Synthase which provides the crop plant with tolerance towards Solanesyl Diphosphate Synthase-inhibiting herbicide.

In some examples, the Solanesyl Diphosphate Synthase may be derived from *Arabidopsis thaliana, Triticum aestivum* (Wheat), *Hordeum vulgare* (Barley), *Oryza sativa* (Rice), *Zea mays* (Maize), *Glycine max* (Soybean), *Chlamydomonas reinhardtii* or *Chlorella usea*. In some examples, the Solanesyl Diphosphate Synthase may be selected from: the SDPS of SEQ II NOS: 1-18, 45-349, and 663-665; or a "modified" SDPS having an amino acid sequence that is at least 80%, at least 85%, at least 90%, at least 95%, at least 96%, at least 97%, at least 98% or at least 99% identical to a sequence set forth in SEQ ID NOS: 1-18, 45-349, and 663-665, or and SDPS having a motif selected from the group consisting of 655-662; or a SDPS having at least one mutation at a position corresponding to one of the following amino acid positions of SEQ ID NO: 5: F240L, F227L, F229L, F247L, L120A, L120R, L120W, L123A, L123C, L123D, L123N, L123S, L123W, E127A, E127G, E127K, E127Y, N128L, N128P, V130D, V130K, L131A, L131E, L131M, L131P, A134V, F139D, F139K, F139N, F139R, F139T, P148I, P148L, P148M, P148T, P148V, V151E, V151F, V151I, V151M, V151N, L174F, L174T, A175I, A175P, A175S, E176A, E176D, E176H, E176K, E176N, E176P, E176Y, I177A, I177C, I177F, I177L, I177M, I177S, I177T, I177Y, I178G, I178Q, I178W, E179I, M180I, M180Q, M180S, M180Y, M180W, I181M, I181N, A184G, A184S, A184T, T183C, T183Q, S185A, S185T, S185G, I187E, I187F, I187T, I187V, H188F, H188I, H188L, H188M, H188V, V191A, V191T, I204A, I204F, I204G, I204H, I204K, I204Q, I204R, I204S, I204T, Y208A, Y208D, Y208E, Y208H, Y208I, Y208K, Y208L, Y208M, Y208N, Y208Q, Y208R, Y208S, Y208T, Y208V, G209N, T210Y, R211D, R211E, R211N, R211T, R211V, L215I, L215M A216T, F219A, M220I, M220C, F221W, A222G, A222M, A222S, Q223A, Q223E, Q223F, Q223G, Q223H, Q223I, Q223K, Q223L, Q223M, Q223R, Q223Y, S224F, S224I, S224M, S224N, S224Q, S224T, S224V, S225C, S225F, S225H, S225I, S225K, S225M, S225N, S225Q, S225T, S225V, S225Y, W226A, W226C, W226E, W226I, W226L, W226Q, W226R, W226T, W226V, F227D, F227L, F227M, F227R, F227V, F227W, L228C, I228I, L228M, L228T, L228V, A229H, A229I, A229L, A229M, A229N, A229T, N230E, N230R, E235G, K238G, K238N, K238S, L239A, L239R, I240A, I240C, I240W, S241A, S241H, S241N, S241T, V243A, V243G, V243N, V243Q, V243S, I244A, I244F, I244G, I244H, I244K, I244L, I244M, I244N, I244P, I244Q, I244S, I244V, I244Y, K245F, K245H, K245M, K245N, K245W, D246E, D246M, D246N, D246Q, D246S, D246T, D246Y, F247E, F247L, F247M, F247N, F247V, A248P, S249A, S249E, S249F, S249G, S249K, S249L, S249N, S249Q, S249T, S249V, S249Y, G250A, I252L, I252M, I252V, K253L, A255T, A255W, S256N, T257E, T257G, T257H, T257M, T257Q, I257W, Y274D, Y274G, Y274L, Y274M, Y274Q, T276S, L279F, I280W, I280F, A282G, A282H, A282K, A282N, A282R, S283C, S283F, S283I, S283M, S283T, S283W, R306F, R306H, R306L, R306N, L310G, G309A, G309F, G309M, G309S, L310D, L310E, L310F, L310H, L310N, L310Q, L310W, L310Y, F312C, F312I, F312L, F312M, F312V, Q313A, Q313C, Q313D, Q313S, and Q313T. In some examples, the Solanesyl Diphosphate Synthase may contain a mutation corresponding to the F240L mutation or equivalent numbering as depicted in SEQ ID NO. 3 or 5. In some examples, the Solanesyl Diphosphate Synthase is provided by editing an endogenous Solanesyl Diphosphate Synthase, for example to achieve any of the above mutations.

When editing an endogenous SDPS. for example, the editing may be performed in a variety of ways. For example, the editing may include at least one of (a) generation of one or more alternative spliced transcripts of a polynucleotide encoding Solanesyl Diphosphate Synthase; (b) deletion of one or more nucleotides in a polynucleotide encoding Solanesyl Diphosphate Synthase; (c) frameshift mutation in one or more exons of a polynucleotide encoding the Solanesyl Diphosphate Synthase; (d) substitution of one or more nucleotides in a polynucleotide encoding Solanesyl Diphosphate Synthase; and (e) deletion or modification of one or more nucleotides of a regulatory element operably linked to the expression of Solanesyl Diphosphate Synthase, wherein the regulatory element includes at least one of a promoter, an intron, 3'UTR, and a terminator. Editing targets may vary and may include, for example, at least one edit to encode a mutation corresponding to one of the amino acid positions of Table 1.

A variety of editing constructs may be used according to the disclosure. For example, constructs may be used that include a nucleic acid that encodes a DNA modification enzyme selected from the group consisting of a site-directed nuclease selected from the group consisting of a meganuclease (MN), a zinc-finger nuclease (ZFN), a transcription-activator like effector nuclease (TALEN), a Cas nuclease (e.g. Cas9 or Cas12), a Cpf1 (sometimes also referred to as Cas 12) nuclease, a dCas9-FokI, a dCpf1-FokI, a chimeric Cas9-cytidine deaminase, a chimeric Cas9-adenine deaminase, a chimeric FEN1-FokI, and a Mega-TALs, a nickase Cas9 (nCas9), a chimeric dCas9 non-FokI nuclease and a dCpf1 non-FokI nuclease; and optionally, at least one guide RNA that corresponds to a target sequence selected from the a sequence that encodes an amino acid of Table 1. In many examples, the DNA modification enzyme is DNA modification enzyme is a site-directed nuclease selected from the group consisting of a Cas9 nuclease, a Cfp1 nuclease, a dCas9-FokI, a dCpf1-FokI, a chimeric Cas9-cytidine deaminase, a chimeric Cas9-adenine deaminase, a chimeric FEN1-FokI, and a Mega-TALs, a nickase Cas9 (nCas9), a chimeric dCas9 non-FokI nuclease and a dCpf1 non-FokI nuclease and the guide RNA will be included.

Target sequences may vary and may include a 15-25 nucleotide long sequence including a sequence, e.g. a 3 nucleotide sequence, that encodes an amino acid of Table 1.

In many examples of crop plants and methods disclosed herein, the crop plant may comprise a further recombinant polynucleotide encoding a further herbicide tolerance enzyme. For example, the further herbicide tolerance enzyme may be selected from the group consisting of, 5-enolpyruvylshikimate-3-phosphate synthase (EPSPS), HST, Glyphosate acetyl transferase (GAT), Cytochrome P450, phosphinothricin acetyltransferase (PAT), Acetolactate synthase (ALS), Protoporphyrinogen oxidase (PPGO), Hydroxyphenyl pyruvate dioxygenase (HPPD) and dicamba degrading enzymes.

Further, it should be clear that pesticide compositions may comprise additional herbicides. For example, one or more additional herbicides may include glyphosate or a salt thereof, glufosinate or a salt thereof, a chloroacetanilide, alachlor, acetochlor, metolachlor, S-metolachlor; a photo system II inhibitor, a triazine, ametryn, atrazine, cyanazine, terbuthylazine, a triazinon, hexazinone, metribuzin, a urea, chlorotoluron, diuron, isoproturon, linuron, tebuthiuron; an ALS-inhibitor, a sulfonyl urea, amidosulfuron, chlorsulfuron, flupyrsulfuron. halosulfuron, nicosulfuron, primisulfuron, prosulfuron, rimsulfuron, triasulfuron, trifloxysulfuron, tritosulfuron, a diphenyl ether, acifluorfen, fomesafen, an HPPD-inhibiting herbicide, mesotrione, bicyclopyrone. dicamba, and 2,4D.

The current disclosure is also directed to recombinant polynucleotides. In one embodiment, the recombinant polynucleotide comprises (i) a region that encodes an Solanesyl Diphosphate Synthase operably linked to a plant operable promoter; and (ii) optionally, at least one additional region, which encodes a herbicide tolerance enzyme selected from the group consisting of hydroxyphenyl pyruvate dioxygenase (HPPD), 5-enolpyruvylshikimate-3-phosphate synthase (EPSPS), Glyphosate acetyl transferase (GAT), Cytochrome P450, phosphinothricin acetyltransferase (PAT), Acetolactate synthase (ALS), Protoporphyrinogen oxidase (PPGO), hydroxyphenyl pyruvate dioxygenase (HPPD) and dicamba degrading enzymes, operably linked to a plant operable promoter.

The region that encodes the Solanesyl Diphosphate Synthase may be (a) a nucleic acid sequence that is at least 90% identical to a sequence selected from the group consisting of SEQ ID NOS: 20-41, 350-654 and 666-668; or a nucleic acid sequence that encodes a polypeptide comprising an amino acid sequence selected from the group consisting of SEQ ID NOS: 1-18, 45-349, and 663-665; or a nucleic acid sequence that encodes a polypeptide comprising an amino acid sequence selected from the group consisting of an amino acid sequence that is at least 95% identical to SEQ ID NOS: 1-18, 45-349, and 663-665; or a nucleic acid sequence that encodes an SDPS having a motif selected from SEQ ID NOS: 655-662; or a nucleic acid sequence that encodes an SDPS having at least one mutation at a position corresponding to one of the following amino acid positions of SEQ ID NO: 5: F240L, F227L, F229L, F247L, L120A, L120R, L120W, L123A, L123C, L123D, L123N, L123S, L123W, E127A, E127G, E127K, E127Y, N128L, N128P, V130D, V130K, L131A, L131E, L131M, L131P, A134V, F139D, F139K, F139N, F139R, F139T, P148I, P148L, P148M, P148T, P148V, V151E, V151F, V151I, V151M, V151N, L174F, L174T, A175I, A175P, A175S, E176A, E176D, E176H, E176K, E176N, E176P, E176Y, I177A, I177C, I177F, I177L, I177M, I177S, I177T, I177Y, I178G, I178Q, I178W, E179I, M180I, M180Q, M180S, M180Y, M180W, I181M, I181N, A184G, A184S, A184T, T183C, T183Q, S185A, S185T, S185G, I187E, I187F, I187T, I187V, H188F, H188I, H188L, H188M, H188V, V191A, V191T, I204A, I204F, I204G, I204H, I204K, I204Q, I204R, I204S, I204T, Y208A, Y208D, Y208E, Y208H, Y208I, Y208K, Y208L, Y208M, Y208N, Y208Q, Y208R, Y208S, Y208T, Y208V, G209N, T210Y, R211D, R211E, R211N, R211T, R211V, L215I, L215M, A216T, F219A, M220I, M220C, F221W, A222G, A222M, A222S, Q223A, Q223E, Q223F, Q223G, Q223H, Q223I, Q223K, Q223L, Q223M, Q223R, Q223Y, S224F, S224I, S224M, S224N, S224Q, S224T, S224V, S225C, S225F, S225H, S225I, S225K, S225M, S225N, S225Q, S225T, S225V, S225Y, W226A, W226C, W226E, W226I, W226L, W226Q, W226R, W226T, W226V, F227D, F227L, F227M, F227R, F227V, F227W, L228C, L228I, L228M, L228T, L228V, A229H, A229I, A229L, A229M, A229N, A229T, N230E, N230R, E235G, K238G, K238N, K238S, L239A, L239R, I240A, I240C, I240W, S241A, S241H, S241N, S241T, V243A, V243G, V243N, V243Q, V243S, I244A, I244F, I244G, I244H, I244K, I244L, I244M, I244N, I244P, I244Q, I244S, I244V, I244Y, K245F, K245H, K245M, K245N, K245W, D246E, D246M, D246N, D246Q, D246S, D246T, D246Y, F247E, F247L, F247M, F247N, F247V, A248P, S249A, S249E, S249F, S249G, S249K, S249L, S249N, S249Q, S249T, S249V, S249Y, G250A, I252L, I252M, I252V, K253L, A255T, A255W, S256N, T257E, T257G, T257H, T257M, T257Q, T257W, Y274D, Y274G, Y274L, Y274M, Y274Q, T276S, L279F, I280W, I280F, A282G, A282H, A282K, A282N, A282R, S283C, S283F, S283I, S283M, S283T, S283W, R306F, R306H, R306L, R306N, L310G, G309A, G309F, G309M, G309S, L310D, L310E, L310F, L310H, L310N, I310Q, L310W, L310Y, F312C, F312I, F312L, F312M, F312V, Q313A, Q313C, Q313D, Q313S, and Q313T.

The disclosure is also directed to a plant cell that is tolerant to a Solanesyl Diphosphate Synthase-inhibiting herbicide. The plant cell my include a recombinant polynucleotide as described above.

The disclosure is also directed to a nucleic acid molecule comprising a nucleotide sequence that encodes a protein capable of providing a crop plant with tolerance against a Solanesyl Diphosphate Synthase-inhibiting herbicide, wherein the nucleotide sequence (a) encodes a protein comprising an amino acid sequence that has at least 80% to at least 99% sequence identity with any of SEQ ID NOs: 1-18, 45-349, and 663-665; (b) is selected from SEQ ID NOS: 20-41, 350-654, and 666-668; (c) is a synthetic sequence of (a) or (b) that has codons optimized for expression in a transgenic organism; or (d) a SDPS having a motif selected from SEQ ID NOS: 655-662; or an SDPS having at least one mutation at a position corresponding to one of the amino acid positions of SEQ ID NO: 5 as exemplified above. In certain examples, the protein comprises an amino acid sequence of SEQ ID NOS: 3 or 13-18.

The current disclosure is also directed to a chimeric gene comprising a heterologous promoter operably linked to a nucleic acid molecule as described above. In typical embodiments, the heterologous promoter is a plant expressible promoter. Suitable plant expressible promoters include ubiquitin, cestrum yellow virus, corn TrpA, OsMADS 6, maize H3 histone, bacteriophage T3 gene 9 5' UTR, corn sucrose synthetase 1, corn alcohol dehydrogenase 1, corn light harvesting complex, corn heat shock protein, maize mtl, pea small subunit RuBP carboxylase, rice actin, rice cyclophilin, Ti plasmid mannopine synthase, Ti plasmid nopaline synthase, petunia chalcone isomerase, bean glycine rich protein 1, potato patatin, lectin, CaMV 35S and S-E9 small subunit RuBP carboxylase promoter.

The current disclosure is also directed to plasmids comprising a chimeric gene as described above as well as to plants comprising the chimeric gene described above, as well as to plants containing the edits described above.

In other examples, the current disclosure is directed to the use of a recombinant Solanesyl Diphosphate Synthase in an in vitro screening method for identifying Solanesyl Diphosphate Synthase-inhibiting herbicides.

In other examples, the current disclosure is directed to the use of a recombinant Solanesyl Diphosphate Synthase in an in vitro screening method for identifying Solanesyl Diphosphate Synthase variants with increased tolerance to Solanesyl Diphosphate Synthase-inhibiting herbicides.

Thus, according to embodiments of the present invention there is provided a method of selectively controlling weeds at a locus comprising crop plants and weeds, the method comprising applying to the locus a weed controlling amount of a pesticide composition comprising a SDPS-inhibiting herbicide, wherein the crop plants are modified such that they comprise a SDPS which provides the crop plant with tolerance against the SDPS-inhibiting herbicide.

Brief Description of the Sequence Listing

SEQ ID NO: 1 is an AA sequence for *Arabidopsis thaliana* SDPS1.

SEQ ID NO: 2 is an AA sequence for *Arabidopsis thaliana* SDPS2.

SEQ ID NO: 3 is an AA sequence for *Arabidopsis thaliana* SDPS2 F240L.

SEQ ID NO: 4 is an AA sequence for *Zea mays* SDPS1.

SEQ ID NO: 5 is an AA sequence for *Zea mays* SDPS2.

SEQ ID NO: 6 is an AA sequence for *Triticum aestivum* SDPS.

SEQ ID NO: 7 is an AA sequence for *Hordeum vulgare* SDPS.

SEQ ID NO: 8 is an AA sequence for *Glycine Max* SDPS.

SEQ ID NO: 9 is an AA sequence for *Oryza sativa* (*japonica*) SDPS.

SEQ ID NO: 10 is an AA sequence for *Chlorella fusca* SDPS.

SEQ ID NO: 11 is an AA sequence for *Chlorella fusca* SDPS F227L.

SEQ ID NO: 12 is an AA sequence for *Chlamydomonas reinhardtii* SDPS.

SEQ ID NO: 13 is an AA sequence for His-Trunc *Arabidopsis thaliana* SDPS2.

SEQ ID NO: 14 is an AA sequence for His-Trunc *Arabidopsis thaliana* SDPS2 F240L.

SEQ ID NO: 15 is an AA sequence for His-Trunc *Zea mays* SDPS1.

SEQ ID NO: 16 is an AA sequence for His-Trunc *Zea mays* SDPS2.

SEQ ID NO: 17 is an AA sequence for His-Trunc *Zea mays* SDPS1 F229L.

SEQ ID NO: 18 is an AA sequence for His-Trunc *Zea mays* SDPS2 F247L.

SEQ ID NO: 19 is a DNA sequence for an plasmid.

SEQ ID NO: 20 is a DNA sequence for *Arabidopsis thaliana* SDPS1.

SEQ ID NO: 21 is a DNA sequence for *Arabidopsis thaliana* SDPS2.

SEQ ID NO: 22 is a DNA sequence for *Arabidopsis thaliana* SDPS2 F240L.

SEQ ID NO: 23 is a DNA sequence for *Zea mays* SDPS1.

SEQ ID NO: 24 is a DNA sequence for *Zea mays* SDPS2.

SEQ ID NO: 25 is a DNA sequence for *Triticum aestivum* SDPS.

SEQ ID NO: 26 is a DNA sequence for *Hordeum vulgare* SDPS.

SEQ ID NO: 27 is a DNA sequence for *Glycine Max* SDPS.

SEQ ID NO: 28 is a DNA sequence for *Oryza sativa* (*japonica*) SDPS.

SEQ ID NO: 29 is a DNA sequence for *Chlorella fusca* SDPS.

SEQ ID NO: 30 is a DNA sequence for *Chlorella fusca* SDPS F227L.

SEQ ID NO: 31 is a DNA sequence for *Chlamydomonas reinhardtii* SDPS.

SEQ ID NO: 32 is a DNA sequence for *E coli* optimised His-Trunc *Arabidopsis thaliana* SDPS2.

SEQ ID NO: 33 is a DNA sequence for *E coli* optimised His-Trunc *Arabidopsis thaliana* SDPS2 F240L.

SEQ ID NO: 34 is a DNA sequence for *E coli* optimised His-Trunc *Zea mays* SDPS1.

SEQ ID NO: 35 is a DNA sequence for *E coli* optimised His-Trunc *Zea mays* SDPS2.

SEQ ID NO: 36 is a DNA sequence for *E coli* optimised His-Trunc *Zea mays* SDPS1 F229L.

SEQ ID NO: 37 is a DNA sequence for *E coli* optimised His-Trunc *Zea mays* SDPS2 F247L.

SEQ ID NO: 38 is a DNA sequence for Tobacco optimised *Arabidopsis thaliana* SDPS2.

SEQ ID NO: 39 is a DNA sequence for Tobacco optimised *Arabidopsis thaliana* SDPS2 F240L.

SEQ ID NO: 40 is a DNA sequence for Tobacco optimised *Chlorella fusca* SDPS.

SEQ ID NO: 41 is a DNA sequence for Tobacco optimised *Chlorella fusca* SDPS F227L.

SEQ ID NO: 42 is a DNA sequence for SDPS Cpf1-Artificial Plasmid.

SEQ ID NO: 43 is a DNA sequence for *Zea mays*, target sequence.

SEQ ID NO: 44 is a DNA sequence for a Cpf1 nuclease.

SEQ ID NO: 45 is a protein sequence for His-Trunc *Zea mays* SDPS2 L120A.

SEQ ID NO: 46 is a protein sequence for His-Trunc *Zea mays* SDPS2 L120R.

SEQ ID NO: 47 is a protein sequence for His-Trunc *Zea mays* SDPS2 L120W.

SEQ ID NO: 48 is a protein sequence for His-Trunc *Zea mays* SDPS2 L123A.

SEQ ID NO: 49 is a protein sequence for His-Trunc *Zea mays* SDPS2 L123C.

SEQ ID NO: 50 is a protein sequence for His-Trunc *Zea mays* SDPS2 L123D.

SEQ ID NO: 51 is a protein sequence for His-Trunc *Zea mays* SDPS2 L123N.

SEQ ID NO: 52 is a protein sequence for His-Trunc *Zea mays* SDPS2 L123S.

SEQ ID NO: 53 is a protein sequence for His-Trunc *Zea mays* SDPS2 L123W.

SEQ ID NO: 54 is a protein sequence for His-Trunc *Zea mays* SDPS2 E127A.

SEQ ID NO: 55 is a protein sequence for His-Trunc *Zea mays* SDPS2 E127G.

SEQ ID NO: 56 is a protein sequence for His-Trunc *Zea mays* SDPS2 E127K.

SEQ ID NO: 57 is a protein sequence for His-Trunc *Zea mays* SDPS2 E127Y.

SEQ ID NO: 58 is a protein sequence for His-Trunc *Zea mays* SDPS2 N128L.

SEQ ID NO: 59 is a protein sequence for His-Trunc *Zea mays* SDPS2 N128P.

SEQ ID NO: 60 is a protein sequence for His-Trunc *Zea mays* SDPS2 V130D.

SEQ ID NO: 61 is a protein sequence for His-Trunc *Zea mays* SDPS2 V130K.

SEQ ID NO: 62 is a protein sequence for His-Trunc *Zea mays* SDPS2 L131A.

SEQ ID NO: 63 is a protein sequence for His-Trunc *Zea mays* SDPS2 L131E.

SEQ ID NO: 64 is a protein sequence for His-Trunc *Zea mays* SDPS2 L131M.

SEQ ID NO: 65 is a protein sequence for His-Trunc *Zea mays* SDPS2 L131P.

SEQ ID NO: 66 is a protein sequence for His-Trunc *Zea mays* SDPS2 A134V.

SEQ ID NO: 67 is a protein sequence for His-Trunc *Zea mays* SDPS2 F139D.

SEQ ID NO: 68 is a protein sequence for His-Trunc *Zea mays* SDPS2 F139K.

SEQ ID NO: 69 is a protein sequence for His-Trunc *Zea mays* SDPS2 F139N.

SEQ ID NO: 70 is a protein sequence for His-Trunc *Zea mays* SDPS2 F139R.

SEQ ID NO: 71 is a protein sequence for His-Trunc *Zea mays* SDPS2 F139T.

SEQ ID NO: 72 is a protein sequence for His-Trunc *Zea mays* SDPS2 P148I.

SEQ ID NO: 73 is a protein sequence for His-Trunc *Zea mays* SDPS2 P148L.

SEQ ID NO: 74 is a protein sequence for His-Trunc *Zea mays* SDPS2 P148M.

SEQ ID NO: 75 is a protein sequence for His-Trunc *Zea mays* SDPS2 P148T.

SEQ ID NO: 76 is a protein sequence for His-Trunc *Zea mays* SDPS2 P148V.

SEQ ID NO: 77 is a protein sequence for His-Trunc *Zea mays* SDPS2 V151E.

SEQ ID NO: 78 is a protein sequence for His-Trunc *Zea mays* SDPS2 V151F.

SEQ ID NO: 79 is a protein sequence for His-Trunc *Zea mays* SDPS2 V151I.

SEQ ID NO: 80 is a protein sequence for His-Trunc *Zea mays* SDPS2 V151M.

SEQ ID NO: 81 is a protein sequence for His-Trunc *Zea mays* SDPS2 V151N.
SEQ ID NO: 82 is a protein sequence for His-Trunc *Zea mays* SDPS2 L174F.
SEQ ID NO: 83 is a protein sequence for His-Trunc *Zea mays* SDPS2 L174T.
SEQ ID NO: 84 is a protein sequence for His-Trunc *Zea mays* SDPS2 A175I.
SEQ ID NO: 85 is a protein sequence for His-Trunc *Zea mays* SDPS2 A175P.
SEQ ID NO: 86 is a protein sequence for His-Trunc *Zea mays* SDPS2 A175S.
SEQ ID NO: 87 is a protein sequence for His-Trunc *Zea mays* SDPS2 E176A.
SEQ ID NO: 88 is a protein sequence for His-Trunc *Zea mays* SDPS2 E176D.
SEQ ID NO: 89 is a protein sequence for His-Trunc *Zea mays* SDPS2 E176H.
SEQ ID NO: 90 is a protein sequence for His-Trunc *Zea mays* SDPS2 E176K.
SEQ ID NO: 91 is a protein sequence for His-Trunc *Zea mays* SDPS2 E176N.
SEQ ID NO: 92 is a protein sequence for His-Trunc *Zea mays* SDPS2 E176P.
SEQ ID NO: 93 is a protein sequence for His-Trunc *Zea mays* SDPS2 E176Y.
SEQ ID NO: 94 is a protein sequence for His-Trunc *Zea mays* SDPS2 I177A.
SEQ ID NO: 95 is a protein sequence for His-Trunc *Zea mays* SDPS2 I177C.
SEQ ID NO: 96 is a protein sequence for His-Trunc *Zea mays* SDPS2 I177F.
SEQ ID NO: 97 is a protein sequence for His-Trunc *Zea mays* SDPS2 I177L.
SEQ ID NO: 98 is a protein sequence for His-Trunc *Zea mays* SDPS2 I177M.
SEQ ID NO: 99 is a protein sequence for His-Trunc *Zea mays* SDPS2 I177S.
SEQ ID NO: 100 is a protein sequence for His-Trunc *Zea mays* SDPS2 I177T.
SEQ ID NO: 101 is a protein sequence for His-Trunc *Zea mays* SDPS2 I177Y.
SEQ ID NO: 102 is a protein sequence for His-Trunc *Zea mays* SDPS2 I178G.
SEQ ID NO: 103 is a protein sequence for His-Trunc *Zea mays* SDPS2 I178Q.
SEQ ID NO: 104 is a protein sequence for His-Trunc *Zea mays* SDPS2 I178W.
SEQ ID NO: 105 is a protein sequence for His-Trunc *Zea mays* SDPS2 E179I.
SEQ ID NO: 106 is a protein sequence for His-Trunc *Zea mays* SDPS2 M180I.
SEQ ID NO: 107 is a protein sequence for His-Trunc *Zea mays* SDPS2 M180Q.
SEQ ID NO: 108 is a protein sequence for His-Trunc *Zea mays* SDPS2 M180S.
SEQ ID NO: 109 is a protein sequence for His-Trunc *Zea mays* SDPS2 M180Y.
SEQ ID NO: 110 is a protein sequence for His-Trunc *Zea mays* SDPS2 M180W.
SEQ ID NO: 111 is a protein sequence for His-Trunc *Zea mays* SDPS2 I118M.
SEQ ID NO: 112 is a protein sequence for His-Trunc *Zea mays* SDPS2 I181N.
SEQ ID NO: 113 is a protein sequence for His-Trunc *Zea mays* SDPS2 A184G.
SEQ ID NO: 114 is a protein sequence for His-Trunc *Zea mays* SDPS2 A184S.
SEQ ID NO: 115 is a protein sequence for His-Trunc *Zea mays* SDPS2 A184T.
SEQ ID NO: 116 is a protein sequence for His-Trunc *Zea mays* SDPS2 T183C.
SEQ ID NO: 117 is a protein sequence for His-Trunc *Zea mays* SDPS2 T183Q.
SEQ ID NO: 118 is a protein sequence for His-Trunc *Zea mays* SDPS2 S185A.
SEQ ID NO: 119 is a protein sequence for His-Trunc *Zea mays* SDPS2 S185T.
SEQ ID NO: 120 is a protein sequence for His-Trunc *Zea mays* SDPS2 S185G.
SEQ ID NO: 121 is a protein sequence for His-Trunc *Zea mays* SDPS2 I187E.
SEQ ID NO: 122 is a protein sequence for His-Trunc *Zea mays* SDPS2 I187F.
SEQ ID NO: 123 is a protein sequence for His-Trunc *Zea mays* SDPS2 I187T.
SEQ ID NO: 124 is a protein sequence for His-Trunc *Zea mays* SDPS2 I187V.
SEQ ID NO: 125 is a protein sequence for His-Trunc *Zea mays* SDPS2 H188F.
SEQ ID NO: 126 is a protein sequence for His-Trunc *Zea mays* SDPS2 H188I.
SEQ ID NO: 127 is a protein sequence for His-Trunc *Zea mays* SDPS2 H188L.
SEQ ID NO: 128 is a protein sequence for His-Trunc *Zea mays* SDPS2 H188M.
SEQ ID NO: 129 is a protein sequence for His-Trunc *Zea mays* SDPS2 H188V.
SEQ ID NO: 130 is a protein sequence for His-Trunc *Zea mays* SDPS2 V191A.
SEQ ID NO: 131 is a protein sequence for His-Trunc *Zea mays* SDPS2 V191T.
SEQ ID NO: 132 is a protein sequence for His-Trunc *Zea mays* SDPS2 I204A.
SEQ ID NO: 133 is a protein sequence for His-Trunc *Zea mays* SDPS2 I204F.
SEQ ID NO: 134 is a protein sequence for His-Trunc *Zea mays* SDPS2 I204G.
SEQ ID NO: 135 is a protein sequence for His-Trunc *Zea mays* SDPS2 I204H.
SEQ ID NO: 136 is a protein sequence for His-Trunc *Zea mays* SDPS2 I204K.
SEQ ID NO: 137 is a protein sequence for His-Trunc *Zea mays* SDPS2 I204Q.
SEQ ID NO: 138 is a protein sequence for His-Trunc *Zea mays* SDPS2 I204R.
SEQ ID NO: 139 is a protein sequence for His-Trunc *Zea mays* SDPS2 I204S.
SEQ ID NO: 140 is a protein sequence for His-Trunc *Zea mays* SDPS2 I204T.
SEQ ID NO: 141 is a protein sequence for His-Trunc *Zea mays* SDPS2 Y208A.
SEQ ID NO: 142 is a protein sequence for His-Trunc *Zea mays* SDPS2 Y208D.
SEQ ID NO: 143 is a protein sequence for His-Trunc *Zea mays* SDPS2 Y208E.
SEQ ID NO: 144 is a protein sequence for His-Trunc *Zea mays* SDPS2 Y208H.
SEQ ID NO: 145 is a protein sequence for His-Trunc *Zea mays* SDPS2 Y208I.
SEQ ID NO: 146 is a protein sequence for His-Trunc *Zea mays* SDPS2 Y208K.

SEQ ID NO: 147 is a protein sequence for His-Trunc *Zea mays* SDPS2 Y208L.
SEQ ID NO: 148 is a protein sequence for His-Trunc *Zea mays* SDPS2 Y208M.
SEQ ID NO: 149 is a protein sequence for His-Trunc *Zea mays* SDPS2 Y208N.
SEQ ID NO: 150 is a protein sequence for His-Trunc *Zea mays* SDPS2 Y208Q.
SEQ ID NO: 151 is a protein sequence for His-Trunc *Zea mays* SDPS2 Y208R.
SEQ ID NO: 152 is a protein sequence for His-Trunc *Zea mays* SDPS2 Y208S.
SEQ ID NO: 153 is a protein sequence for His-Trunc *Zea mays* SDPS2 Y208T.
SEQ ID NO: 154 is a protein sequence for His-Trunc *Zea mays* SDPS2 Y208V.
SEQ ID NO: 155 is a protein sequence for His-Trunc *Zea mays* SDPS2 G209N.
SEQ ID NO: 156 is a protein sequence for His-Trunc *Zea mays* SDPS2 T210Y.
SEQ ID NO: 157 is a protein sequence for His-Trunc *Zea mays* SDPS2 R211D.
SEQ ID NO: 158 is a protein sequence for His-Trunc *Zea mays* SDPS2 R211E.
SEQ ID NO: 159 is a protein sequence for His-Trunc *Zea mays* SDPS2 R211N.
SEQ ID NO: 160 is a protein sequence for His-Trunc *Zea mays* SDPS2 R211T.
SEQ ID NO: 161 is a protein sequence for His-Trunc *Zea mays* SDPS2 R211V.
SEQ ID NO: 162 is a protein sequence for His-Trunc *Zea mays* SDPS2 L215I.
SEQ ID NO: 163 is a protein sequence for His-Trunc *Zea mays* SDPS2 L215M.
SEQ ID NO: 164 is a protein sequence for His-Trunc *Zea mays* SDPS2 A216T.
SEQ ID NO: 165 is a protein sequence for His-Trunc *Zea mays* SDPS2 F219A.
SEQ ID NO: 166 is a protein sequence for His-Trunc *Zea mays* SDPS2 M220I.
SEQ ID NO: 167 is a protein sequence for His-Trunc *Zea mays* SDPS2 M220C.
SEQ ID NO: 168 is a protein sequence for His-Trunc *Zea mays* SDPS2 F221W.
SEQ ID NO: 169 is a protein sequence for His-Trunc *Zea mays* SDPS2 A222G.
SEQ ID NO: 170 is a protein sequence for His-Trunc *Zea mays* SDPS2 A222M.
SEQ ID NO: 171 is a protein sequence for His-Trunc *Zea mays* SDPS2 A222S.
SEQ ID NO: 172 is a protein sequence for His-Trunc *Zea mays* SDPS2 Q223A.
SEQ ID NO: 173 is a protein sequence for His-Trunc *Zea mays* SDPS2 Q223E.
SEQ ID NO: 174 is a protein sequence for His-Trunc *Zea mays* SDPS2 Q223F.
SEQ ID NO: 175 is a protein sequence for His-Trunc *Zea mays* SDPS2 Q223G.
SEQ ID NO: 176 is a protein sequence for His-Trunc *Zea mays* SDPS2 Q223H.
SEQ ID NO: 177 is a protein sequence for His-Trunc *Zea mays* SDPS2 Q223I.
SEQ ID NO: 178 is a protein sequence for His-Trunc *Zea mays* SDPS2 Q223K.
SEQ ID NO: 179 is a protein sequence for His-Trunc *Zea mays* SDPS2 Q223L.
SEQ ID NO: 180 is a protein sequence for His-Trunc *Zea mays* SDPS2 Q223M.
SEQ ID NO: 181 is a protein sequence for His-Trunc *Zea mays* SDPS2 Q223R.
SEQ ID NO: 182 is a protein sequence for His-Trunc *Zea mays* SDPS2 Q223Y.
SEQ ID NO: 183 is a protein sequence for His-Trunc *Zea mays* SDPS2 S224F.
SEQ ID NO: 184 is a protein sequence for His-Trunc *Zea mays* SDPS2 S224I.
SEQ ID NO: 185 is a protein sequence for His-Trunc *Zea mays* SDPS2 S224M.
SEQ ID NO: 186 is a protein sequence for His-Trunc *Zea mays* SDPS2 S224N.
SEQ ID NO: 187 is a protein sequence for His-Trunc *Zea mays* SDPS2 S224Q.
SEQ ID NO: 188 is a protein sequence for His-Trunc *Zea mays* SDPS2 S224T.
SEQ ID NO: 189 is a protein sequence for His-Trunc *Zea mays* SDPS2 S224V.
SEQ ID NO: 190 is a protein sequence for His-Trunc *Zea mays* SDPS2 S225C.
SEQ ID NO: 191 is a protein sequence for His-Trunc *Zea mays* SDPS2 S225F.
SEQ ID NO: 192 is a protein sequence for His-Trunc *Zea mays* SDPS2 S225H.
SEQ ID NO: 193 is a protein sequence for His-Trunc *Zea mays* SDPS2 S225I.
SEQ ID NO: 194 is a protein sequence for His-Trunc *Zea mays* SDPS2 S225K.
SEQ ID NO: 195 is a protein sequence for His-Trunc *Zea mays* SDPS2 S225M.
SEQ ID NO: 196 is a protein sequence for His-Trunc *Zea mays* SDPS2 S225N.
SEQ ID NO: 197 is a protein sequence for His-Trunc *Zea mays* SDPS2 S225Q.
SEQ ID NO: 198 is a protein sequence for His-Trunc *Zea mays* SDPS2 S225T.
SEQ ID NO: 199 is a protein sequence for His-Trunc *Zea mays* SDPS2 S225V.
SEQ ID NO: 200 is a protein sequence for His-Trunc *Zea mays* SDPS2 S225Y.
SEQ ID NO: 201 is a protein sequence for His-Trunc *Zea mays* SDPS2 W226A.
SEQ ID NO: 202 is a protein sequence for His-Trunc *Zea mays* SDPS2 W226C.
SEQ ID NO: 203 is a protein sequence for His-Trunc *Zea mays* SDPS2 W226E.
SEQ ID NO: 204 is a protein sequence for His-Trunc *Zea mays* SDPS2 W226I.
SEQ ID NO: 205 is a protein sequence for His-Trunc *Zea mays* SDPS2 W226L.
SEQ ID NO: 206 is a protein sequence for His-Trunc *Zea mays* SDPS2 W226Q.
SEQ ID NO: 207 is a protein sequence for His-Trunc *Zea mays* SDPS2 W226R.
SEQ ID NO: 208 is a protein sequence for His-Trunc *Zea mays* SDPS2 W226T.
SEQ ID NO: 209 is a protein sequence for His-Trunc *Zea mays* SDPS2 W226V.
SEQ ID NO: 210 is a protein sequence for His-Trunc *Zea mays* SDPS2 F227D.
SEQ ID NO: 211 is a protein sequence for His-Trunc *Zea mays* SDPS2 F227L.
SEQ ID NO: 212 is a protein sequence for His-Trunc *Zea mays* SDPS2 F227M.

SEQ ID NO: 213 is a protein sequence for His-Trunc *Zea mays* SDPS2 F227R.
SEQ ID NO: 214 is a protein sequence for His-Trunc *Zea mays* SDPS2 F227V.
SEQ ID NO: 215 is a protein sequence for His-Trunc *Zea mays* SDPS2 F227W.
SEQ ID NO: 216 is a protein sequence for His-Trunc *Zea mays* SDPS2 L228C.
SEQ ID NO: 217 is a protein sequence for His-Trunc *Zea mays* SDPS2 L228I.
SEQ ID NO: 218 is a protein sequence for His-Trunc *Zea mays* SDPS2 L228M.
SEQ ID NO: 219 is a protein sequence for His-Trunc *Zea mays* SDPS2 L228T.
SEQ ID NO: 220 is a protein sequence for His-Trunc *Zea mays* SDPS2 L228V.
SEQ ID NO: 221 is a protein sequence for His-Trunc *Zea mays* SDPS2 A229H.
SEQ ID NO: 222 is a protein sequence for His-Trunc *Zea mays* SDPS2 A229I.
SEQ ID NO: 223 is a protein sequence for His-Trunc *Zea mays* SDPS2 A229L.
SEQ ID NO: 224 is a protein sequence for His-Trunc *Zea mays* SDPS2 A229M.
SEQ ID NO: 225 is a protein sequence for His-Trunc *Zea mays* SDPS2 A229N.
SEQ ID NO: 226 is a protein sequence for His-Trunc *Zea mays* SDPS2 A229T.
SEQ ID NO: 227 is a protein sequence for His-Trunc *Zea mays* SDPS2 N230E.
SEQ ID NO: 228 is a protein sequence for His-Trunc *Zea mays* SDPS2 N230R.
SEQ ID NO: 229 is a protein sequence for His-Trunc *Zea mays* SDPS2 E235G.
SEQ ID NO: 230 is a protein sequence for His-Trunc *Zea mays* SDPS2 K238G.
SEQ ID NO: 231 is a protein sequence for His-Trunc *Zea mays* SDPS2 K238N.
SEQ ID NO: 232 is a protein sequence for His-Trunc *Zea mays* SDPS2 K238S.
SEQ ID NO: 233 is a protein sequence for His-Trunc *Zea mays* SDPS2 L239A.
SEQ ID NO: 234 is a protein sequence for His-Trunc *Zea mays* SDPS2 L239R.
SEQ ID NO: 235 is a protein sequence for His-Trunc *Zea mays* SDPS2 I240A.
SEQ ID NO: 236 is a protein sequence for His-Trunc *Zea mays* SDPS2 I240C.
SEQ ID NO: 237 is a protein sequence for His-Trunc *Zea mays* SDPS2 I240W.
SEQ ID NO: 238 is a protein sequence for His-Trunc *Zea mays* SDPS2 S241A.
SEQ ID NO: 239 is a protein sequence for His-Trunc *Zea mays* SDPS2 S241H.
SEQ ID NO: 240 is a protein sequence for His-Trunc *Zea mays* SDPS2 S241N.
SEQ ID NO: 241 is a protein sequence for His-Trunc *Zea mays* SDPS2 S241T.
SEQ ID NO: 242 is a protein sequence for His-Trunc *Zea mays* SDPS2 V243A.
SEQ ID NO: 243 is a protein sequence for His-Trunc *Zea mays* SDPS2 V243G.
SEQ ID NO: 244 is a protein sequence for His-Trunc *Zea mays* SDPS2 V243N.
SEQ ID NO: 245 is a protein sequence for His-Trunc *Zea mays* SDPS2 V243Q.
SEQ ID NO: 246 is a protein sequence for His-Trunc *Zea mays* SDPS2 V243S.
SEQ ID NO: 247 is a protein sequence for His-Trunc *Zea mays* SDPS2 I244A.
SEQ ID NO: 248 is a protein sequence for His-Trunc *Zea mays* SDPS2 I244F.
SEQ ID NO: 249 is a protein sequence for His-Trunc *Zea mays* SDPS2 I244G.
SEQ ID NO: 250 is a protein sequence for His-Trunc *Zea mays* SDPS2 I244H.
SEQ ID NO: 251 is a protein sequence for His-Trunc *Zea mays* SDPS2 I244K.
SEQ ID NO: 252 is a protein sequence for His-Trunc *Zea mays* SDPS2 I244L.
SEQ ID NO: 253 is a protein sequence for His-Trunc *Zea mays* SDPS2 I244M.
SEQ ID NO: 254 is a protein sequence for His-Trunc *Zea mays* SDPS2 I244N.
SEQ ID NO: 255 is a protein sequence for His-Trunc *Zea mays* SDPS2 I244P.
SEQ ID NO: 256 is a protein sequence for His-Trunc *Zea mays* SDPS2 I244Q.
SEQ ID NO: 257 is a protein sequence for His-Trunc *Zea mays* SDPS2 I244S.
SEQ ID NO: 258 is a protein sequence for His-Trunc *Zea mays* SDPS2 I244V.
SEQ ID NO: 259 is a protein sequence for His-Trunc *Zea mays* SDPS2 I244Y.
SEQ ID NO: 260 is a protein sequence for His-Trunc *Zea mays* SDPS2 K245F.
SEQ ID NO: 261 is a protein sequence for His-Trunc *Zea mays* SDPS2 K245H.
SEQ ID NO: 262 is a protein sequence for His-Trunc *Zea mays* SDPS2 K245M.
SEQ ID NO: 263 is a protein sequence for His-Trunc *Zea mays* SDPS2 K245N.
SEQ ID NO: 264 is a protein sequence for His-Trunc *Zea mays* SDPS2 K245W.
SEQ ID NO: 265 is a protein sequence for His-Trunc *Zea mays* SDPS2 D246E.
SEQ ID NO: 266 is a protein sequence for His-Trunc *Zea mays* SDPS2 D246M.
SEQ ID NO: 267 is a protein sequence for His-Trunc *Zea mays* SDPS2 D246N.
SEQ ID NO: 268 is a protein sequence for His-Trunc *Zea mays* SDPS2 D246Q.
SEQ ID NO: 269 is a protein sequence for His-Trunc *Zea mays* SDPS2 D246S.
SEQ ID NO: 270 is a protein sequence for His-Trunc *Zea mays* SDPS2 D246T.
SEQ ID NO: 271 is a protein sequence for His-Trunc *Zea mays* SDPS2 D246Y.
SEQ ID NO: 272 is a protein sequence for His-Trunc *Zea mays* SDPS2 F247E.
SEQ ID NO: 273 is a protein sequence for His-Trunc *Zea mays* SDPS2 F247L.
SEQ ID NO: 274 is a protein sequence for His-Trunc *Zea mays* SDPS2 F247M.
SEQ ID NO: 275 is a protein sequence for His-Trunc *Zea mays* SDPS2 F247N.
SEQ ID NO: 276 is a protein sequence for His-Trunc *Zea mays* SDPS2 F247V.
SEQ ID NO: 277 is a protein sequence for His-Trunc *Zea mays* SDPS2 A248P.
SEQ ID NO: 278 is a protein sequence for His-Trunc *Zea mays* SDPS2 S249A.

SEQ ID NO: 279 is a protein sequence for His-Trunc *Zea mays* SDPS2 S249E.
SEQ ID NO: 280 is a protein sequence for His-Trunc *Zea mays* SDPS2 S249F.
SEQ ID NO: 281 is a protein sequence for His-Trunc *Zea mays* SDPS2 S249G.
SEQ ID NO: 282 is a protein sequence for His-Trunc *Zea mays* SDPS2 S249K.
SEQ ID NO: 283 is a protein sequence for His-Trunc *Zea mays* SDPS2 S249L.
SEQ ID NO: 284 is a protein sequence for His-Trunc *Zea mays* SDPS2 S249N.
SEQ ID NO: 285 is a protein sequence for His-Trunc *Zea mays* SDPS2 S249Q.
SEQ ID NO: 286 is a protein sequence for His-Trunc *Zea mays* SDPS2 S249T.
SEQ ID NO: 287 is a protein sequence for His-Trunc *Zea mays* SDPS2 S249V.
SEQ ID NO: 288 is a protein sequence for His-Trunc *Zea mays* SDPS2 S249Y.
SEQ ID NO: 289 is a protein sequence for His-Trunc *Zea mays* SDPS2 G250A.
SEQ ID NO: 290 is a protein sequence for His-Trunc *Zea mays* SDPS2 I252L.
SEQ ID NO: 291 is a protein sequence for His-Trunc *Zea mays* SDPS2 I252M.
SEQ ID NO: 292 is a protein sequence for His-Trunc *Zea mays* SDPS2 I252V.
SEQ ID NO: 293 is a protein sequence for His-Trunc *Zea mays* SDPS2 K253L.
SEQ ID NO: 294 is a protein sequence for His-Trunc *Zea mays* SDPS2 A255T.
SEQ ID NO: 295 is a protein sequence for His-Trunc *Zea mays* SDPS2 A255W.
SEQ ID NO: 296 is a protein sequence for His-Trunc *Zea mays* SDPS2 S256N.
SEQ ID NO: 297 is a protein sequence for His-Trunc *Zea mays* SDPS2 T257E.
SEQ ID NO: 298 is a protein sequence for His-Trunc *Zea mays* SDPS2 T257G.
SEQ ID NO: 299 is a protein sequence for His-Trunc *Zea mays* SDPS2 T257H.
SEQ ID NO: 300 is a protein sequence for His-Trunc *Zea mays* SDPS2 T257M.
SEQ ID NO: 301 is a protein sequence for His-Trunc *Zea mays* SDPS2 T257Q.
SEQ ID NO: 302 is a protein sequence for His-Trunc *Zea mays* SDPS2 T257W.
SEQ ID NO: 303 is a protein sequence for His-Trunc *Zea mays* SDPS2 Y274D.
SEQ ID NO: 304 is a protein sequence for His-Trunc *Zea mays* SDPS2 Y274G.
SEQ ID NO: 305 is a protein sequence for His-Trunc *Zea mays* SDPS2 Y274L.
SEQ ID NO: 306 is a protein sequence for His-Trunc *Zea mays* SDPS2 Y274M.
SEQ ID NO: 307 is a protein sequence for His-Trunc *Zea mays* SDPS2 Y274Q.
SEQ ID NO: 308 is a protein sequence for His-Trunc *Zea mays* SDPS2 T276S.
SEQ ID NO: 309 is a protein sequence for His-Trunc *Zea mays* SDPS2 L279F.
SEQ ID NO: 310 is a protein sequence for His-Trunc *Zea mays* SDPS2 I280W.
SEQ ID NO: 311 is a protein sequence for His-Trunc *Zea mays* SDPS2 I280F.
SEQ ID NO: 312 is a protein sequence for His-Trunc *Zea mays* SDPS2 A282G.
SEQ ID NO: 313 is a protein sequence for His-Trunc *Zea mays* SDPS2 A282H.
SEQ ID NO: 314 is a protein sequence for His-Trunc *Zea mays* SDPS2 A282K.
SEQ ID NO: 315 is a protein sequence for His-Trunc *Zea mays* SDPS2 A282N.
SEQ ID NO: 316 is a protein sequence for His-Trunc *Zea mays* SDPS2 A282R.
SEQ ID NO: 317 is a protein sequence for His-Trunc *Zea mays* SDPS2 S283C.
SEQ ID NO: 318 is a protein sequence for His-Trunc *Zea mays* SDPS2 S283F.
SEQ ID NO: 319 is a protein sequence for His-Trunc *Zea mays* SDPS2 S283I.
SEQ ID NO: 320 is a protein sequence for His-Trunc *Zea mays* SDPS2 S283M.
SEQ ID NO: 321 is a protein sequence for His-Trunc *Zea mays* SDPS2 S283T.
SEQ ID NO: 322 is a protein sequence for His-Trunc *Zea mays* SDPS2 S283W.
SEQ ID NO: 323 is a protein sequence for His-Trunc *Zea mays* SDPS2 R306F.
SEQ ID NO: 324 is a protein sequence for His-Trunc *Zea mays* SDPS2 R306H.
SEQ ID NO: 325 is a protein sequence for His-Trunc *Zea mays* SDPS2 R306L.
SEQ ID NO: 326 is a protein sequence for His-Trunc *Zea mays* SDPS2 R306N.
SEQ ID NO: 327 is a protein sequence for His-Trunc *Zea mays* SDPS2 L310G.
SEQ ID NO: 328 is a protein sequence for His-Trunc *Zea mays* SDPS2 G309A.
SEQ ID NO: 329 is a protein sequence for His-Trunc *Zea mays* SDPS2 G309F.
SEQ ID NO: 330 is a protein sequence for His-Trunc *Zea mays* SDPS2 G309M.
SEQ ID NO: 331 is a protein sequence for His-Trunc *Zea mays* SDPS2 G309S.
SEQ ID NO: 332 is a protein sequence for His-Trunc *Zea mays* SDPS2 L310D.
SEQ ID NO: 333 is a protein sequence for His-Trunc *Zea mays* SDPS2 L310E.
SEQ ID NO: 334 is a protein sequence for His-Trunc *Zea mays* SDPS2 L310F.
SEQ ID NO: 335 is a protein sequence for His-Trunc *Zea mays* SDPS2 L310H.
SEQ ID NO: 336 is a protein sequence for His-Trunc *Zea mays* SDPS2 L310N.
SEQ ID NO: 337 is a protein sequence for His-Trunc *Zea mays* SDPS2 L310Q.
SEQ ID NO: 338 is a protein sequence for His-Trunc *Zea mays* SDPS2 L310W.
SEQ ID NO: 339 is a protein sequence for His-Trunc *Zea mays* SDPS2 L310Y.
SEQ ID NO: 340 is a protein sequence for His-Trunc *Zea mays* SDPS2 F312C.
SEQ ID NO: 341 is a protein sequence for His-Trunc *Zea mays* SDPS2 F312I.
SEQ ID NO: 342 is a protein sequence for His-Trunc *Zea mays* SDPS2 F312L.
SEQ ID NO: 343 is a protein sequence for His-Trunc *Zea mays* SDPS2 F312M.
SEQ ID NO: 344 is a protein sequence for His-Trunc *Zea mays* SDPS2 F312V.

SEQ ID NO: 345 is a protein sequence for His-Trunc *Zea mays* SDPS2 Q313A.

SEQ ID NO: 346 is a protein sequence for His-Trunc *Zea mays* SDPS2 Q313C.

SEQ ID NO: 347 is a protein sequence for His-Trunc *Zea mays* SDPS2 Q313D.

SEQ ID NO: 348 is a protein sequence for His-Trunc *Zea mays* SDPS2 Q313S.

SEQ ID NO: 349 is a protein sequence for His-Trunc *Zea mays* SDPS2 Q313T.

SEQ ID NO: 350 is a DNA sequence for *E coli* optimised His-Trunc *Zea mays* SDPS2 L120A.

SEQ ID NO: 351 is a DNA sequence for *E coli* optimised His-Trunc *Zea mays* SDPS2 L120R.

SEQ ID NO: 352 is a DNA sequence for *E coli* optimised His-Trunc *Zea mays* SDPS2 L120W.

SEQ ID NO: 353 is a DNA sequence for *E coli* optimised His-Trunc *Zea mays* SDPS2 L123A.

SEQ ID NO: 354 is a DNA sequence for *E coli* optimised His-Trunc *Zea mays* SDPS2 L123C.

SEQ ID NO: 355 is a DNA sequence for *E coli* optimised His-Trunc *Zea mays* SDPS2 L123D.

SEQ ID NO: 356 is a DNA sequence for *E coli* optimised His-Trunc *Zea mays* SDPS2 L123N.

SEQ ID NO: 357 is a DNA sequence for *E coli* optimised His-Trunc *Zea mays* SDPS2 L123S.

SEQ ID NO: 358 is a DNA sequence for *E coli* optimised His-Trunc *Zea mays* SDPS2 L123W.

SEQ ID NO: 359 is a DNA sequence for *E coli* optimised His-Trunc *Zea mays* SDPS2 E127A.

SEQ ID NO: 360 is a DNA sequence for *E coli* optimised His-Trunc *Zea mays* SDPS2 E127G.

SEQ ID NO: 361 is a DNA sequence for *E coli* optimised His-Trunc *Zea mays* SDPS2 E127K.

SEQ ID NO: 362 is a DNA sequence for *E coli* optimised His-Trunc *Zea mays* SDPS2 E127Y.

SEQ ID NO: 363 is a DNA sequence for *E coli* optimised His-Trunc *Zea mays* SDPS2 N128L.

SEQ ID NO: 364 is a DNA sequence for *E coli* optimised His-Trunc *Zea mays* SDPS2 N128P.

SEQ ID NO: 365 is a DNA sequence for *E coli* optimised His-Trunc *Zea mays* SDPS2 V130D.

SEQ ID NO: 366 is a DNA sequence for *E coli* optimised His-Trunc *Zea mays* SDPS2 V130K.

SEQ ID NO: 367 is a DNA sequence for *E coli* optimised His-Trunc *Zea mays* SDPS2 L131A.

SEQ ID NO: 368 is a DNA sequence for *E coli* optimised His-Trunc *Zea mays* SDPS2 L131E.

SEQ ID NO: 369 is a DNA sequence for *E coli* optimised His-Trunc *Zea mays* SDPS2 L131M.

SEQ ID NO: 370 is a DNA sequence for *E coli* optimised His-Trunc *Zea mays* SDPS2 L131P.

SEQ ID NO: 371 is a DNA sequence for *E coli* optimised His-Trunc *Zea mays* SDPS2 A134V.

SEQ ID NO: 372 is a DNA sequence for *E coli* optimised His-Trunc *Zea mays* SDPS2 F139D.

SEQ ID NO: 373 is a DNA sequence for *E coli* optimised His-Trunc *Zea mays* SDPS2 F139K.

SEQ ID NO: 374 is a DNA sequence for *E coli* optimised His-Trunc *Zea mays* SDPS2 F139N.

SEQ ID NO: 375 is a DNA sequence for *E coli* optimised His-Trunc *Zea mays* SDPS2 F139R.

SEQ ID NO: 376 is a DNA sequence for *E coli* optimised His-Trunc *Zea mays* SDPS2 F139T.

SEQ ID NO: 377 is a DNA sequence for *E coli* optimised His-Trunc *Zea mays* SDPS2 P148I.

SEQ ID NO: 378 is a DNA sequence for *E coli* optimised His-Trunc *Zea mays* SDPS2 P148L.

SEQ ID NO: 379 is a DNA sequence for *E coli* optimised His-Trunc *Zea mays* SDPS2 P148M.

SEQ ID NO: 380 is a DNA sequence for *E coli* optimised His-Trunc *Zea mays* SDPS2 P148T.

SEQ ID NO: 381 is a DNA sequence for *E coli* optimised His-Trunc *Zea mays* SDPS2 P148V.

SEQ ID NO: 382 is a DNA sequence for *E coli* optimised His-Trunc *Zea mays* SDPS2 V151E.

SEQ ID NO: 383 is a DNA sequence for *E coli* optimised His-Trunc *Zea mays* SDPS2 V151F.

SEQ ID NO: 384 is a DNA sequence for *E coli* optimised His-Trunc *Zea mays* SDPS2 V151I.

SEQ ID NO: 385 is a DNA sequence for *E coli* optimised His-Trunc *Zea mays* SDPS2 V151M.

SEQ ID NO: 386 is a DNA sequence for *E coli* optimised His-Trunc *Zea mays* SDPS2 V151N.

SEQ ID NO: 387 is a DNA sequence for *E coli* optimised His-Trunc *Zea mays* SDPS2 L174F.

SEQ ID NO: 388 is a DNA sequence for *E coli* optimised His-Trunc *Zea mays* SDPS2 L174T.

SEQ ID NO: 389 is a DNA sequence for *E coli* optimised His-Trunc *Zea mays* SDPS2 A175I.

SEQ ID NO: 390 is a DNA sequence for *E coli* optimised His-Trunc *Zea mays* SDPS2 A175P.

SEQ ID NO: 391 is a DNA sequence for *E coli* optimised His-Trunc *Zea mays* SDPS2 A175S.

SEQ ID NO: 392 is a DNA sequence for *E coli* optimised His-Trunc *Zea mays* SDPS2 E176A.

SEQ ID NO: 393 is a DNA sequence for *E coli* optimised His-Trunc *Zea mays* SDPS2 E176D.

SEQ ID NO: 394 is a DNA sequence for *E coli* optimised His-Trunc *Zea mays* SDPS2 E176H.

SEQ ID NO: 395 is a DNA sequence for *E coli* optimised His-Trunc *Zea mays* SDPS2 E176K.

SEQ ID NO: 396 is a DNA sequence for *E coli* optimised His-Trunc *Zea mays* SDPS2 E176N.

SEQ ID NO: 397 is a DNA sequence for *E coli* optimised His-Trunc *Zea mays* SDPS2 E176P.

SEQ ID NO: 398 is a DNA sequence for *E coli* optimised His-Trunc *Zea mays* SDPS2 E176Y.

SEQ ID NO: 399 is a DNA sequence for *E coli* optimised His-Trunc *Zea mays* SDPS2 I177A.

SEQ ID NO: 400 is a DNA sequence for *E coli* optimised His-Trunc *Zea mays* SDPS2 I177C.

SEQ ID NO: 401 is a DNA sequence for *E coli* optimised His-Trunc *Zea mays* SDPS2 I177F.

SEQ ID NO: 402 is a DNA sequence for *E coli* optimised His-Trunc *Zea mays* SDPS2 I177L.

SEQ ID NO: 403 is a DNA sequence for *E coli* optimised His-Trunc *Zea mays* SDPS2 I177M.

SEQ ID NO: 404 is a DNA sequence for *E coli* optimised His-Trunc *Zea mays* SDPS2 I177S.

SEQ ID NO: 405 is a DNA sequence for *E coli* optimised His-Trunc *Zea mays* SDPS2 I177T.

SEQ ID NO: 406 is a DNA sequence for *E coli* optimised His-Trunc *Zea mays* SDPS2 I177Y.

SEQ ID NO: 407 is a DNA sequence for *E coli* optimised His-Trunc *Zea mays* SDPS2 I178G.

SEQ ID NO: 408 is a DNA sequence for *E coli* optimised His-Trunc *Zea mays* SDPS2 I178Q.

SEQ ID NO: 409 is a DNA sequence for *E coli* optimised His-Trunc *Zea mays* SDPS2 I178W.

SEQ ID NO: 410 is a DNA sequence for *E coli* optimised His-Trunc *Zea mays* SDPS2 E179I.

SEQ ID NO: 411 is a DNA sequence for *E coli* optimised His-Trunc *Zea mays* SDPS2 M180I.

SEQ ID NO: 412 is a DNA sequence for *E coli* optimised His-Trunc *Zea mays* SDPS2 M180Q.

SEQ ID NO: 413 is a DNA sequence for *E coli* optimised His-Trunc *Zea mays* SDPS2 M180S.

SEQ ID NO: 414 is a DNA sequence for *E coli* optimised His-Trunc *Zea mays* SDPS2 M180Y.

SEQ ID NO: 415 is a DNA sequence for *E coli* optimised His-Trunc *Zea mays* SDPS2 M180W.

SEQ ID NO: 416 is a DNA sequence for *E coli* optimised His-Trunc *Zea mays* SDPS2 I181M.

SEQ ID NO: 417 is a DNA sequence for *E coli* optimised His-Trunc *Zea mays* SDPS2 I181N.

SEQ ID NO: 418 is a DNA sequence for *E coli* optimised His-Trunc *Zea mays* SDPS2 A184G.

SEQ ID NO: 419 is a DNA sequence for *E coli* optimised His-Trunc *Zea mays* SDPS2 A184S.

SEQ ID NO: 420 is a DNA sequence for *E coli* optimised His-Trunc *Zea mays* SDPS2 A184T.

SEQ ID NO: 421 is a DNA sequence for *E coli* optimised His-Trunc *Zea mays* SDPS2 T183C.

SEQ ID NO: 422 is a DNA sequence for *E coli* optimised His-Trunc *Zea mays* SDPS2 T183Q.

SEQ ID NO: 423 is a DNA sequence for *E coli* optimised His-Trunc *Zea mays* SDPS2 S185A.

SEQ ID NO: 424 is a DNA sequence for *E coli* optimised His-Trunc *Zea mays* SDPS2 S185T.

SEQ ID NO: 425 is a DNA sequence for *E coli* optimised His-Trunc *Zea mays* SDPS2 S185G.

SEQ ID NO: 426 is a DNA sequence for *E coli* optimised His-Trunc *Zea mays* SDPS2 H188F.

SEQ ID NO: 427 is a DNA sequence for *E coli* optimised His-Trunc *Zea mays* SDPS2 H188I.

SEQ ID NO: 428 is a DNA sequence for *E coli* optimised His-Trunc *Zea mays* SDPS2 H188L.

SEQ ID NO: 429 is a DNA sequence for *E coli* optimised His-Trunc *Zea mays* SDPS2 H188M.

SEQ ID NO: 430 is a DNA sequence for *E coli* optimised His-Trunc *Zea mays* SDPS2 H188V.

SEQ ID NO: 431 is a DNA sequence for *E coli* optimised His-Trunc *Zea mays* SDPS2 I187E.

SEQ ID NO: 432 is a DNA sequence for *E coli* optimised His-Trunc *Zea mays* SDPS2 I187F.

SEQ ID NO: 433 is a DNA sequence for *E coli* optimised His-Trunc *Zea mays* SDPS2 I187T.

SEQ ID NO: 434 is a DNA sequence for *E coli* optimised His-Trunc *Zea mays* SDPS2 I187V.

SEQ ID NO: 435 is a DNA sequence for *E coli* optimised His-Trunc *Zea mays* SDPS2 V191A.

SEQ ID NO: 436 is a DNA sequence for *E coli* optimised His-Trunc *Zea mays* SDPS2 V191T.

SEQ ID NO: 437 is a DNA sequence for *E coli* optimised His-Trunc *Zea mays* SDPS2 I204A.

SEQ ID NO: 438 is a DNA sequence for *E coli* optimised His-Trunc *Zea mays* SDPS2 I204F.

SEQ ID NO: 439 is a DNA sequence for *E coli* optimised His-Trunc *Zea mays* SDPS2 I204G.

SEQ ID NO: 440 is a DNA sequence for *E coli* optimised His-Trunc *Zea mays* SDPS2 I204H.

SEQ ID NO: 441 is a DNA sequence for *E coli* optimised His-Trunc *Zea mays* SDPS2 I204K.

SEQ ID NO: 442 is a DNA sequence for *E coli* optimised His-Trunc *Zea mays* SDPS2 I204Q.

SEQ ID NO: 443 is a DNA sequence for *E coli* optimised His-Trunc *Zea mays* SDPS2 I204R.

SEQ ID NO: 444 is a DNA sequence for *E coli* optimised His-Trunc *Zea mays* SDPS2 I204S.

SEQ ID NO: 445 is a DNA sequence for *E coli* optimised His-Trunc *Zea mays* SDPS2 I204T.

SEQ ID NO: 446 is a DNA sequence for *E coli* optimised His-Trunc *Zea mays* SDPS2 Y208A.

SEQ ID NO: 447 is a DNA sequence for *E coli* optimised His-Trunc *Zea mays* SDPS2 Y208D.

SEQ ID NO: 448 is a DNA sequence for *E coli* optimised His-Trunc *Zea mays* SDPS2 Y208E.

SEQ ID NO: 449 is a DNA sequence for *E coli* optimised His-Trunc *Zea mays* SDPS2 Y208H.

SEQ ID NO: 450 is a DNA sequence for *E coli* optimised His-Trunc *Zea mays* SDPS2 Y208I.

SEQ ID NO: 451 is a DNA sequence for *E coli* optimised His-Trunc *Zea mays* SDPS2 Y208K.

SEQ ID NO: 452 is a DNA sequence for *E coli* optimised His-Trunc *Zea mays* SDPS2 Y208L.

SEQ ID NO: 453 is a DNA sequence for *E coli* optimised His-Trunc *Zea mays* SDPS2 Y208M.

SEQ ID NO: 454 is a DNA sequence for *E coli* optimised His-Trunc *Zea mays* SDPS2 Y208N.

SEQ ID NO: 455 is a DNA sequence for *E coli* optimised His-Trunc *Zea mays* SDPS2 Y208Q.

SEQ ID NO: 456 is a DNA sequence for *E coli* optimised His-Trunc *Zea mays* SDPS2 Y208R.

SEQ ID NO: 457 is a DNA sequence for *E coli* optimised His-Trunc *Zea mays* SDPS2 Y208S.

SEQ ID NO: 458 is a DNA sequence for *E coli* optimised His-Trunc *Zea mays* SDPS2 Y208T.

SEQ ID NO: 459 is a DNA sequence for *E coli* optimised His-Trunc *Zea mays* SDPS2 Y208V.

SEQ ID NO: 460 is a DNA sequence for *E coli* optimised His-Trunc *Zea mays* SDPS2 G209N.

SEQ ID NO: 461 is a DNA sequence for *E coli* optimised His-Trunc *Zea mays* SDPS2 T210Y.

SEQ ID NO: 462 is a DNA sequence for *E coli* optimised His-Trunc *Zea mays* SDPS2 R211D.

SEQ ID NO: 463 is a DNA sequence for *E coli* optimised His-Trunc *Zea mays* SDPS2 R211E.

SEQ ID NO: 464 is a DNA sequence for *E coli* optimised His-Trunc *Zea mays* SDPS2 R211N.

SEQ ID NO: 465 is a DNA sequence for *E coli* optimised His-Trunc *Zea mays* SDPS2 R211T.

SEQ ID NO: 466 is a DNA sequence for *E coli* optimised His-Trunc *Zea mays* SDPS2 R211V.

SEQ ID NO: 467 is a DNA sequence for *E coli* optimised His-Trunc *Zea mays* SDPS2 I215I.

SEQ ID NO: 468 is a DNA sequence for *E coli* optimised His-Trunc *Zea mays* SDPS2 L215M.

SEQ ID NO: 469 is a DNA sequence for *E coli* optimised His-Trunc *Zea mays* SDPS2 A216T.

SEQ ID NO: 470 is a DNA sequence for *E coli* optimised His-Trunc *Zea mays* SDPS2 F219A.

SEQ ID NO: 471 is a DNA sequence for *E coli* optimised His-Trunc *Zea mays* SDPS2 M220I.

SEQ ID NO: 472 is a DNA sequence for *E coli* optimised His-Trunc *Zea mays* SDPS2 M220C.

SEQ ID NO: 473 is a DNA sequence for *E coli* optimised His-Trunc *Zea mays* SDPS2 F221W.

SEQ ID NO: 474 is a DNA sequence for *E coli* optimised His-Trunc *Zea mays* SDPS2 A222G.

SEQ ID NO: 475 is a DNA sequence for *E coli* optimised His-Trunc *Zea mays* SDPS2 A222M.

SEQ ID NO: 476 is a DNA sequence for *E coli* optimised His-Trunc *Zea mays* SDPS2 A222S.

SEQ ID NO: 477 is a DNA sequence for *E coli* optimised His-Trunc *Zea mays* SDPS2 Q223A.

SEQ ID NO: 478 is a DNA sequence for *E coli* optimised His-Trunc *Zea mays* SDPS2 Q223E.

SEQ ID NO: 479 is a DNA sequence for *E coli* optimised His-Trunc *Zea mays* SDPS2 Q223F.

SEQ ID NO: 480 is a DNA sequence for *E coli* optimised His-Trunc *Zea mays* SDPS2 Q223G.

SEQ ID NO: 481 is a DNA sequence for *E coli* optimised His-Trunc *Zea mays* SDPS2 Q223H.

SEQ ID NO: 482 is a DNA sequence for *E coli* optimised His-Trunc *Zea mays* SDPS2 Q223I.

SEQ ID NO: 483 is a DNA sequence for *E coli* optimised His-Trunc *Zea mays* SDPS2 Q223K.

SEQ ID NO: 484 is a DNA sequence for *E coli* optimised His-Trunc *Zea mays* SDPS2 Q223L.

SEQ ID NO: 485 is a DNA sequence for *E coli* optimised His-Trunc *Zea mays* SDPS2 Q223M.

SEQ ID NO: 486 is a DNA sequence for *E coli* optimised His-Trunc *Zea mays* SDPS2 Q223R.

SEQ ID NO: 487 is a DNA sequence for *E coli* optimised His-Trunc *Zea mays* SDPS2 Q223Y.

SEQ ID NO: 488 is a DNA sequence for *E coli* optimised His-Trunc *Zea mays* SDPS2 S224F.

SEQ ID NO: 489 is a DNA sequence for *E coli* optimised His-Trunc *Zea mays* SDPS2 S224I.

SEQ ID NO: 490 is a DNA sequence for *E coli* optimised His-Trunc *Zea mays* SDPS2 S224M.

SEQ ID NO: 491 is a DNA sequence for *E coli* optimised His-Trunc *Zea mays* SDPS2 S224N.

SEQ ID NO: 492 is a DNA sequence for *E coli* optimised His-Trunc *Zea mays* SDPS2 S224Q.

SEQ ID NO: 493 is a DNA sequence for *E coli* optimised His-Trunc *Zea mays* SDPS2 S224T.

SEQ ID NO: 494 is a DNA sequence for *E coli* optimised His-Trunc *Zea mays* SDPS2 S224V.

SEQ ID NO: 495 is a DNA sequence for *E coli* optimised His-Trunc *Zea mays* SDPS2 S225C.

SEQ ID NO: 496 is a DNA sequence for *E coli* optimised His-Trunc *Zea mays* SDPS2 S225F.

SEQ ID NO: 497 is a DNA sequence for *E coli* optimised His-Trunc *Zea mays* SDPS2 S225H.

SEQ ID NO: 498 is a DNA sequence for *E coli* optimised His-Trunc *Zea mays* SDPS2 S225I.

SEQ ID NO: 499 is a DNA sequence for *E coli* optimised His-Trunc *Zea mays* SDPS2 S225K.

SEQ ID NO: 500 is a DNA sequence for *E coli* optimised His-Trunc *Zea mays* SDPS2 S225M.

SEQ ID NO: 501 is a DNA sequence for *E coli* optimised His-Trunc *Zea mays* SDPS2 S225N.

SEQ ID NO: 502 is a DNA sequence for *E coli* optimised His-Trunc *Zea mays* SDPS2 S225Q.

SEQ ID NO: 503 is a DNA sequence for *E coli* optimised His-Trunc *Zea mays* SDPS2 S225T.

SEQ ID NO: 504 is a DNA sequence for *E coli* optimised His-Trunc *Zea mays* SDPS2 S225V.

SEQ ID NO: 505 is a DNA sequence for *E coli* optimised His-Trunc *Zea mays* SDPS2 S225Y.

SEQ ID NO: 506 is a DNA sequence for *E coli* optimised His-Trunc *Zea mays* SDPS2 W226A.

SEQ ID NO: 507 is a DNA sequence for *E coli* optimised His-Trunc *Zea mays* SDPS2 W226C.

SEQ ID NO: 508 is a DNA sequence for *E coli* optimised His-Trunc *Zea mays* SDPS2 W226E.

SEQ ID NO: 509 is a DNA sequence for *E coli* optimised His-Trunc *Zea mays* SDPS2 W226I.

SEQ ID NO: 510 is a DNA sequence for *E coli* optimised His-Trunc *Zea mays* SDPS2 W226L.

SEQ ID NO: 511 is a DNA sequence for *E coli* optimised His-Trunc *Zea mays* SDPS2 W226Q.

SEQ ID NO: 512 is a DNA sequence for *E coli* optimised His-Trunc *Zea mays* SDPS2 W226R.

SEQ ID NO: 513 is a DNA sequence for *E coli* optimised His-Trunc *Zea mays* SDPS2 W226T.

SEQ ID NO: 514 is a DNA sequence for *E coli* optimised His-Trunc *Zea mays* SDPS2 W226V.

SEQ ID NO: 515 is a DNA sequence for *E coli* optimised His-Trunc *Zea mays* SDPS2 F227D.

SEQ ID NO: 516 is a DNA sequence for *E coli* optimised His-Trunc *Zea mays* SDPS2 F227L.

SEQ ID NO: 517 is a DNA sequence for *E coli* optimised His-Trunc *Zea mays* SDPS2 F227M.

SEQ ID NO: 518 is a DNA sequence for *E coli* optimised His-Trunc *Zea mays* SDPS2 F227R.

SEQ ID NO: 519 is a DNA sequence for *E coli* optimised His-Trunc *Zea mays* SDPS2 F227V.

SEQ ID NO: 520 is a DNA sequence for *E coli* optimised His-Trunc *Zea mays* SDPS2 F227W.

SEQ ID NO: 521 is a DNA sequence for *E coli* optimised His-Trunc *Zea mays* SDPS2 L228C.

SEQ ID NO: 522 is a DNA sequence for *E coli* optimised His-Trunc *Zea mays* SDPS2 L228I.

SEQ ID NO: 523 is a DNA sequence for *E coli* optimised His-Trunc *Zea mays* SDPS2 L228M.

SEQ ID NO: 524 is a DNA sequence for *E coli* optimised His-Trunc *Zea mays* SDPS2 L228T.

SEQ ID NO: 525 is a DNA sequence for *E coli* optimised His-Trunc *Zea mays* SDPS2 L228V.

SEQ ID NO: 526 is a DNA sequence for *E coli* optimised His-Trunc *Zea mays* SDPS2 A229H.

SEQ ID NO: 527 is a DNA sequence for *E coli* optimised His-Trunc *Zea mays* SDPS2 A229I.

SEQ ID NO: 528 is a DNA sequence for *E coli* optimised His-Trunc *Zea mays* SDPS2 A229L.

SEQ ID NO: 529 is a DNA sequence for *E coli* optimised His-Trunc *Zea mays* SDPS2 A229M.

SEQ ID NO: 530 is a DNA sequence for *E coli* optimised His-Trunc *Zea mays* SDPS2 A229N.

SEQ ID NO: 531 is a DNA sequence for *E coli* optimised His-Trunc *Zea mays* SDPS2 A229T.

SEQ ID NO: 532 is a DNA sequence for *E coli* optimised His-Trunc *Zea mays* SDPS2 N230E.

SEQ ID NO: 533 is a DNA sequence for *E coli* optimised His-Trunc *Zea mays* SDPS2 N230R.

SEQ ID NO: 534 is a DNA sequence for *E coli* optimised His-Trunc *Zea mays* SDPS2 E235G.

SEQ ID NO: 535 is a DNA sequence for *E coli* optimised His-Trunc *Zea mays* SDPS2 K238G.

SEQ ID NO: 536 is a DNA sequence for *E coli* optimised His-Trunc *Zea mays* SDPS2 K238N.

SEQ ID NO: 537 is a DNA sequence for *E coli* optimised His-Trunc *Zea mays* SDPS2 K238S.

SEQ ID NO: 538 is a DNA sequence for *E coli* optimised His-Trunc *Zea mays* SDPS2 L239A.

SEQ ID NO: 539 is a DNA sequence for *E coli* optimised His-Trunc *Zea mays* SDPS2 L239R.

SEQ ID NO: 540 is a DNA sequence for *E coli* optimised His-Trunc *Zea mays* SDPS2 I240A.

SEQ ID NO: 541 is a DNA sequence for *E coli* optimised His-Trunc *Zea mays* SDPS2 I240C.

SEQ ID NO: 542 is a DNA sequence for *E coli* optimised His-Trunc *Zea mays* SDPS2 I240W.

SEQ ID NO: 543 is a DNA sequence for *E coli* optimised His-Trunc *Zea mays* SDPS2 S241A.
SEQ ID NO: 544 is a DNA sequence for *E coli* optimised His-Trunc *Zea mays* SDPS2 S241H.
SEQ ID NO: 545 is a DNA sequence for *E coli* optimised His-Trunc *Zea mays* SDPS2 S241N.
SEQ ID NO: 546 is a DNA sequence for *E coli* optimised His-Trunc *Zea mays* SDPS2 S241T.
SEQ ID NO: 547 is a DNA sequence for *E coli* optimised His-Trunc *Zea mays* SDPS2 V243A.
SEQ ID NO: 548 is a DNA sequence for *E coli* optimised His-Trunc *Zea mays* SDPS2 V243G.
SEQ ID NO: 549 is a DNA sequence for *E coli* optimised His-Trunc *Zea mays* SDPS2 V243N.
SEQ ID NO: 550 is a DNA sequence for *E coli* optimised His-Trunc *Zea mays* SDPS2 V243Q.
SEQ ID NO: 551 is a DNA sequence for *E coli* optimised His-Trunc *Zea mays* SDPS2 V243S.
SEQ ID NO: 552 is a DNA sequence for *E coli* optimised His-Trunc *Zea mays* SDPS2 I244A.
SEQ ID NO: 553 is a DNA sequence for *E coli* optimised His-Trunc *Zea mays* SDPS2 I244F.
SEQ ID NO: 554 is a DNA sequence for *E coli* optimised His-Trunc *Zea mays* SDPS2 I244G.
SEQ ID NO: 555 is a DNA sequence for *E coli* optimised His-Trunc *Zea mays* SDPS2 I244H.
SEQ ID NO: 556 is a DNA sequence for *E coli* optimised His-Trunc *Zea mays* SDPS2 I244K.
SEQ ID NO: 557 is a DNA sequence for *E coli* optimised His-Trunc *Zea mays* SDPS2 I244L.
SEQ ID NO: 558 is a DNA sequence for *E coli* optimised His-Trunc *Zea mays* SDPS2 I244M.
SEQ ID NO: 559 is a DNA sequence for *E coli* optimised His-Trunc *Zea mays* SDPS2 I244N.
SEQ ID NO: 560 is a DNA sequence for *E coli* optimised His-Trunc *Zea mays* SDPS2 I244P.
SEQ ID NO: 561 is a DNA sequence for *E coli* optimised His-Trunc *Zea mays* SDPS2 I244Q.
SEQ ID NO: 562 is a DNA sequence for *E coli* optimised His-Trunc *Zea mays* SDPS2 I244S.
SEQ ID NO: 563 is a DNA sequence for *E coli* optimised His-Trunc *Zea mays* SDPS2 I244V.
SEQ ID NO: 564 is a DNA sequence for *E coli* optimised His-Trunc *Zea mays* SDPS2 I244Y.
SEQ ID NO: 565 is a DNA sequence for *E coli* optimised His-Trunc *Zea mays* SDPS2 K245F.
SEQ ID NO: 566 is a DNA sequence for *E coli* optimised His-Trunc *Zea mays* SDPS2 K245H.
SEQ ID NO: 567 is a DNA sequence for *E coli* optimised His-Trunc *Zea mays* SDPS2 K245M.
SEQ ID NO: 568 is a DNA sequence for *E coli* optimised His-Trunc *Zea mays* SDPS2 K245N.
SEQ ID NO: 569 is a DNA sequence for *E coli* optimised His-Trunc *Zea mays* SDPS2 K245W.
SEQ ID NO: 570 is a DNA sequence for *E coli* optimised His-Trunc *Zea mays* SDPS2 D246E.
SEQ ID NO: 571 is a DNA sequence for *E coli* optimised His-Trunc *Zea mays* SDPS2 D246M.
SEQ ID NO: 572 is a DNA sequence for *E coli* optimised His-Trunc *Zea mays* SDPS2 D246N.
SEQ ID NO: 573 is a DNA sequence for *E coli* optimised His-Trunc *Zea mays* SDPS2 D246Q.
SEQ ID NO: 574 is a DNA sequence for *E coli* optimised His-Trunc *Zea mays* SDPS2 D246S.
SEQ ID NO: 575 is a DNA sequence for *E coli* optimised His-Trunc *Zea mays* SDPS2 D246T.
SEQ ID NO: 576 is a DNA sequence for *E coli* optimised His-Trunc *Zea mays* SDPS2 D246Y.
SEQ ID NO: 577 is a DNA sequence for *E coli* optimised His-Trunc *Zea mays* SDPS2 F247E.
SEQ ID NO: 578 is a DNA sequence for *E coli* optimised His-Trunc *Zea mays* SDPS2 F247L.
SEQ ID NO: 579 is a DNA sequence for *E coli* optimised His-Trunc *Zea mays* SDPS2 F247M.
SEQ ID NO: 580 is a DNA sequence for *E coli* optimised His-Trunc *Zea mays* SDPS2 F247N.
SEQ ID NO: 581 is a DNA sequence for *E coli* optimised His-Trunc *Zea mays* SDPS2 F247V.
SEQ ID NO: 582 is a DNA sequence for *E coli* optimised His-Trunc *Zea mays* SDPS2 A248P.
SEQ ID NO: 583 is a DNA sequence for *E coli* optimised His-Trunc *Zea mays* SDPS2 S249A.
SEQ ID NO: 584 is a DNA sequence for *E coli* optimised His-Trunc *Zea mays* SDPS2 S249E.
SEQ ID NO: 585 is a DNA sequence for *E coli* optimised His-Trunc *Zea mays* SDPS2 S249F.
SEQ ID NO: 586 is a DNA sequence for *E coli* optimised His-Trunc *Zea mays* SDPS2 S249G.
SEQ ID NO: 587 is a DNA sequence for *E coli* optimised His-Trunc *Zea mays* SDPS2 S249K.
SEQ ID NO: 588 is a DNA sequence for *E coli* optimised His-Trunc *Zea mays* SDPS2 S249L.
SEQ ID NO: 589 is a DNA sequence for *E coli* optimised His-Trunc *Zea mays* SDPS2 S249N.
SEQ ID NO: 590 is a DNA sequence for *E coli* optimised His-Trunc *Zea mays* SDPS2 S249Q.
SEQ ID NO: 591 is a DNA sequence for *E coli* optimised His-Trunc *Zea mays* SDPS2 S249T.
SEQ ID NO: 592 is a DNA sequence for *E coli* optimised His-Trunc *Zea mays* SDPS2 S249V.
SEQ ID NO: 593 is a DNA sequence for *E coli* optimised His-Trunc *Zea mays* SDPS2 S249Y.
SEQ ID NO: 594 is a DNA sequence for *E coli* optimised His-Trunc *Zea mays* SDPS2 G250A.
SEQ ID NO: 595 is a DNA sequence for *E coli* optimised His-Trunc *Zea mays* SDPS2 I252L.
SEQ ID NO: 596 is a DNA sequence for *E coli* optimised His-Trunc *Zea mays* SDPS2 I252M.
SEQ ID NO: 597 is a DNA sequence for *E coli* optimised His-Trunc *Zea mays* SDPS2 I252V.
SEQ ID NO: 598 is a DNA sequence for *E coli* optimised His-Trunc *Zea mays* SDPS2 K253L.
SEQ ID NO: 599 is a DNA sequence for *E coli* optimised His-Trunc *Zea mays* SDPS2 A255T.
SEQ ID NO: 600 is a DNA sequence for *E coli* optimised His-Trunc *Zea mays* SDPS2 A255W.
SEQ ID NO: 601 is a DNA sequence for *E coli* optimised His-Trunc *Zea mays* SDPS2 S256N.
SEQ ID NO: 602 is a DNA sequence for *E coli* optimised His-Trunc *Zea mays* SDPS2 T257E.
SEQ ID NO: 603 is a DNA sequence for *E coli* optimised His-Trunc *Zea mays* SDPS2 T257G.
SEQ ID NO: 604 is a DNA sequence for *E coli* optimised His-Trunc *Zea mays* SDPS2 T257H.
SEQ ID NO: 605 is a DNA sequence for *E coli* optimised His-Trunc *Zea mays* SDPS2 T257M.
SEQ ID NO: 606 is a DNA sequence for *E coli* optimised His-Trunc *Zea mays* SDPS2 T257Q.
SEQ ID NO: 607 is a DNA sequence for *E coli* optimised His-Trunc *Zea mays* SDPS2 T257W.
SEQ ID NO: 608 is a DNA sequence for *E coli* optimised His-Trunc *Zea mays* SDPS2 Y274D.

SEQ ID NO: 609 is a DNA sequence for *E coli* optimised His-Trunc *Zea mays* SDPS2 Y274G.

SEQ ID NO: 610 is a DNA sequence for *E coli* optimised His-Trunc *Zea mays* SDPS2 Y274L.

SEQ ID NO: 611 is a DNA sequence for *E coli* optimised His-Trunc *Zea mays* SDPS2 Y274M.

SEQ ID NO: 612 is a DNA sequence for *E coli* optimised His-Trunc *Zea mays* SDPS2 Y274Q.

SEQ ID NO: 613 is a DNA sequence for *E coli* optimised His-Trunc *Zea mays* SDPS2 T276S.

SEQ ID NO: 614 is a DNA sequence for *E coli* optimised His-Trunc *Zea mays* SDPS2 L279F.

SEQ ID NO: 615 is a DNA sequence for *E coli* optimised His-Trunc *Zea mays* SDPS2 I280W.

SEQ ID NO: 616 is a DNA sequence for *E coli* optimised His-Trunc *Zea mays* SDPS2 I280F.

SEQ ID NO: 617 is a DNA sequence for *E coli* optimised His-Trunc *Zea mays* SDPS2 A282G.

SEQ ID NO: 618 is a DNA sequence for *E coli* optimised His-Trunc *Zea mays* SDPS2 A282H.

SEQ ID NO: 619 is a DNA sequence for *E coli* optimised His-Trunc *Zea mays* SDPS2 A282K.

SEQ ID NO: 620 is a DNA sequence for *E coli* optimised His-Trunc *Zea mays* SDPS2 A282N.

SEQ ID NO: 621 is a DNA sequence for *E coli* optimised His-Trunc *Zea mays* SDPS2 A282R.

SEQ ID NO: 622 is a DNA sequence for *E coli* optimised His-Trunc *Zea mays* SDPS2 S283C.

SEQ ID NO: 623 is a DNA sequence for *E coli* optimised His-Trunc *Zea mays* SDPS2 S283F.

SEQ ID NO: 624 is a DNA sequence for *E coli* optimised His-Trunc *Zea mays* SDPS2 S283I.

SEQ ID NO: 625 is a DNA sequence for *E coli* optimised His-Trunc *Zea mays* SDPS2 S283M.

SEQ ID NO: 626 is a DNA sequence for *E coli* optimised His-Trunc *Zea mays* SDPS2 S283T.

SEQ ID NO: 627 is a DNA sequence for *E coli* optimised His-Trunc *Zea mays* SDPS2 S283W.

SEQ ID NO: 628 is a DNA sequence for *E coli* optimised His-Trunc *Zea mays* SDPS2 R306F.

SEQ ID NO: 629 is a DNA sequence for *E coli* optimised His-Trunc *Zea mays* SDPS2 R306H.

SEQ ID NO: 630 is a DNA sequence for *E coli* optimised His-Trunc *Zea mays* SDPS2 R306L.

SEQ ID NO: 631 is a DNA sequence for *E coli* optimised His-Trunc *Zea mays* SDPS2 R306N.

SEQ ID NO: 632 is a DNA sequence for *E coli* optimised His-Trunc *Zea mays* SDPS2 L310G.

SEQ ID NO: 633 is a DNA sequence for *E coli* optimised His-Trunc *Zea mays* SDPS2 G309A.

SEQ ID NO: 634 is a DNA sequence for *E coli* optimised His-Trunc *Zea mays* SDPS2 G309F.

SEQ ID NO: 635 is a DNA sequence for *E coli* optimised His-Trunc *Zea mays* SDPS2 G309M.

SEQ ID NO: 636 is a DNA sequence for *E coli* optimised His-Trunc *Zea mays* SDPS2 G309S.

SEQ ID NO: 637 is a DNA sequence for *E coli* optimised His-Trunc *Zea mays* SDPS2 L310D.

SEQ ID NO: 638 is a DNA sequence for *E coli* optimised His-Trunc *Zea mays* SDPS2 L310E.

SEQ ID NO: 639 is a DNA sequence for *E coli* optimised His-Trunc *Zea mays* SDPS2 L310F.

SEQ ID NO: 640 is a DNA sequence for *E coli* optimised His-Trunc *Zea mays* SDPS2 L310H.

SEQ ID NO: 641 is a DNA sequence for *E coli* optimised His-Trunc *Zea mays* SDPS2 L310N.

SEQ ID NO: 642 is a DNA sequence for *E coli* optimised His-Trunc *Zea mays* SDPS2 L310Q.

SEQ ID NO: 643 is a DNA sequence for *E coli* optimised His-Trunc *Zea mays* SDPS2 L310W.

SEQ ID NO: 644 is a DNA sequence for *E coli* optimised His-Trunc *Zea mays* SDPS2 L310Y.

SEQ ID NO: 645 is a DNA sequence for *E coli* optimised His-Trunc *Zea mays* SDPS2 F312C.

SEQ ID NO: 646 is a DNA sequence for *E coli* optimised His-Trunc *Zea mays* SDPS2 F312I.

SEQ ID NO: 647 is a DNA sequence for *E coli* optimised His-Trunc *Zea mays* SDPS2 F312L.

SEQ ID NO: 648 is a DNA sequence for *E coli* optimised His-Trunc *Zea mays* SDPS2 F312M.

SEQ ID NO: 649 is a DNA sequence for *E coli* optimised His-Trunc *Zea mays* SDPS2 F312V.

SEQ ID NO: 650 is a DNA sequence for *E coli* optimised His-Trunc *Zea mays* SDPS2 Q313A.

SEQ ID NO: 651 is a DNA sequence for *E coli* optimised His-Trunc *Zea mays* SDPS2 Q313C.

SEQ ID NO: 652 is a DNA sequence for *E coli* optimised His-Trunc *Zea mays* SDPS2 Q313D.

SEQ ID NO: 653 is a DNA sequence for *E coli* optimised His-Trunc *Zea mays* SDPS2 Q313S.

SEQ ID NO: 654 is a DNA sequence for *E coli* optimised His-Trunc *Zea mays* SDPS2 Q313T.

SEQ ID NO: 655 is a SDPS protein sequence motif of N,X1,N,X2,X3,X4,X5,X6,G,X7,X8,X9,P,X10,X11, X12,X13,A,X14,X15,Q,I,X16,X17,A,G,G,K.

SEQ ID NO: 656 is a SDPS protein sequence motif of K,X1,X2,R,X3,X4,X5,X6,F,L.

SEQ ID NO: 657 is a SDPS protein sequence motif of H,X1,R,X2,X3,X4,X5,X6,7,X8,X9,H,X10,X11,X12, L,X13,X14,D,D,X15,X16,D.

SEQ ID NO: 658 a SDPS protein sequence motif of G,X1,X2,T,X3,X4,X5,X6,X7,X8,X9,X10,X11,A,V, X12,X13,G,D,X14.

SEQ ID NO: 659 a SDPS protein sequence motif of X1,X2,X3,X4,X5,X6,X7,X8,X9,X10,X11,L,E.

SEQ ID NO: 660 a SDPS protein sequence motif of N,X1,X2,V,I,X3,X4,X5,X6,X7,X8,X9,X10,X11,X12, X13,X14,X15,E,X16,X17,Q,X18,X19,X20.

SEQ ID NO: 661 a SDPS protein sequence motif of S,X1,X2,K,X3,A,S,X4,X5,A,X6,X7,X8.

SEQ ID NO: 662 a SDPS protein sequence motif of G,X1,X2,L,X3,X4,X5,X6,X7,V,V.

SEQ ID NO: 663 is a protein sequence for His-Trunc *Zea mays* SDPS2 N128Y.

SEQ ID NO: 664 is a protein sequence for His-Trunc *Zea mays* SDPS2 T183G.

SEQ ID NO: 665 is a protein sequence for His-Trunc *Zea mays* SDPS2 A184C.

SEQ ID NO: 666 is a DNA sequence for *E coli* optimised His-Trunc *Zea mays* SDPS2 N128Y.

SEQ ID NO: 667 is a DNA sequence for *E coli* optimised His-Trunc *Zea mays* SDPS2 T183C.

SEQ ID NO: 668 is a DNA sequence for *E coli* optimised His-Trunc *Zea mays* SDPS2 A184C.

BRIEF DESCRIPTION OF THE FIGURES

FIG. 3 is a table showing the damage scores for 4 populations of plants expressing various SDPS genes.

DETAILED DESCRIPTION

Figure 1:
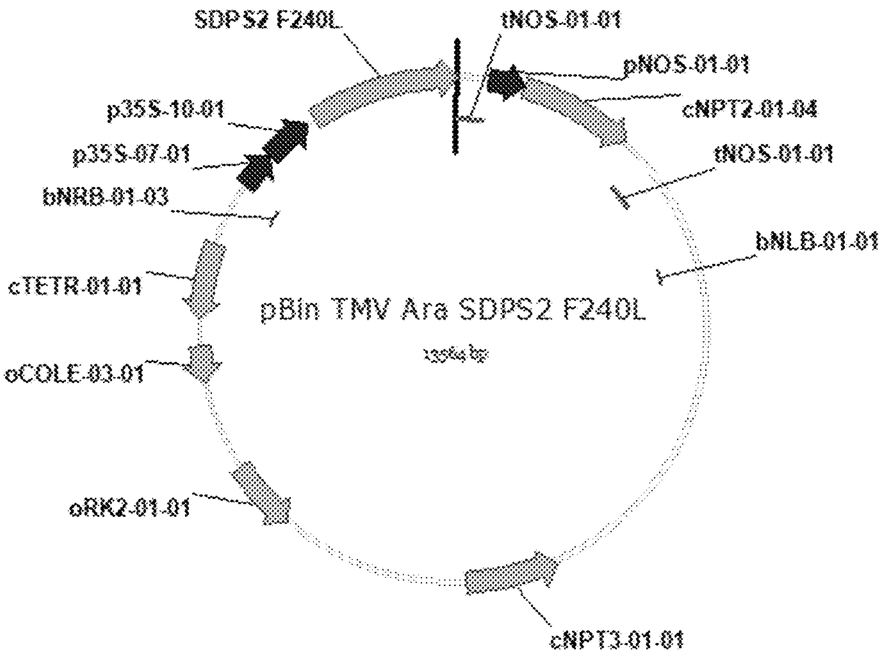
FIG. 1 shows a representation of vector F240L for transformation for gene insertion.

This description is not intended to be a detailed catalogue of all the different ways in which the invention may be implemented, or all the features that may be added to the instant invention. For example, features illustrated with respect to one embodiment may be incorporated into other embodiments, and features illustrated with respect to a particular embodiment may be deleted from that embodiment. Thus, the invention contemplates that in some embodiments of the invention, any feature or combination of features set forth herein can be excluded or omitted. In addition, numerous variations and additions to the various embodiments suggested herein will be apparent to those skilled in the art in light of the instant disclosure, which do not depart from the instant invention. Hence, the following descriptions are intended to illustrate some particular embodiments of the invention, and not to exhaustively specify all permutations, combinations and variations thereof.

Unless otherwise defined, all technical and scientific terms used herein have the same meaning as commonly understood by one of ordinary skill in the art to which this invention belongs. The terminology used in the description of the invention herein is for the purpose of describing particular embodiments only and is not intended to be limiting of the invention.

Definitions

As used herein and in the appended claims, the singular forms "a," "an," and "the" include plural reference unless the context clearly dictates otherwise. Thus, for example, reference to "a plant" is a reference to one or more plants and includes equivalents thereof known to those skilled in the art, and so forth.

As used herein, the word "and/or" refers to and encompasses any and all possible combinations of one or more of the associated listed items, as well as the lack of combinations when interpreted in the alternative, "or."

The term "about" is used herein to mean approximately, roughly, around, or in the region of. When the term "about" is used in conjunction with a numerical range, it modifies that range by extending the boundaries above and below the numerical values set forth. In general, the term "about" is used herein to modify a numerical value above and below the stated value by a variance of 20 percent, preferably 10 percent up or down (higher or lower). With regard to a temperature the term "about" means±1° C., preferably ±0.5° C. Where the term "about" is used in the context of this invention (e.g., in combinations with temperature or molecular weight values) the exact value (i.e., without "about") is preferred.

As used herein, the term "amplified" means the construction of multiple copies of a nucleic acid molecule or multiple copies complementary to the nucleic acid molecule using at least one of the nucleic acid molecules as a template. Amplification systems include the polymerase chain reaction (PCR) system. ligase chain reaction (LCR) system. nucleic acid sequence based amplification (NASBA, Cangene, Mississauga, Ontario), Q-Beta Replicase systems, transcription-based amplification system (TAS), and strand displacement amplification (SDA). Sec, e.g., Diagnostic Molecular Microbiology: Principles and Applications, PERSING et al., Ed., American Society for Microbiology, Washington, D.C. (1993). The product of amplification is termed an "amplicon."

An "assembled sequence," "assembled polynucleotide," "assembled nucleotide sequence," and the like, according to the invention is a synthetic polynucleotide made by aligning overlapping sequences of polynucleotides or portions of sequenced polynucleotides, i.e. k-mers (all the possible subsequences of length k from a read obtained through DNA sequencing), that are determined from genomic DNA using DNA sequencing technology. Assembled sequences typically contain base-calling errors, which can be incorrectly determined bases, insertions and/or deletions compared to the native DNA sequence comprised in the genome from which the genomic DNA is obtained. Therefore, for example, an "assembled polynucleotide" may encode a protein and according to the invention both the polynucleotide and the protein are not products of nature, but exist only by human activity.

The term "chimeric construct" or "chimeric gene" or "chimeric polynucleotide" or "chimeric nucleic acid" (or similar terms) as used herein refers to a construct or molecule comprising two or more polynucleotides of different origin assembled into a single nucleic acid molecule. The term "chimeric construct", "chimeric gene", "chimeric polynucleotide" or "chimeric nucleic acid" refers to any construct or molecule that contains, without limitation, (1) polynucleotides (e.g., DNA), including regulatory and coding polynucleotides that are not found together in nature (i.e., at least one of the polynucleotides in the construct is heterologous with respect to at least one of its other polynucleotides), or (2) polynucleotides encoding parts of proteins not naturally adjoined, or (3) parts of promoters that are not naturally adjoined. Further, a chimeric construct, chimeric gene, chimeric polynucleotide or chimeric nucleic acid may comprise regulatory polynucleotides and coding polynucleotides that are derived from different sources, or comprise regulatory polynucleotides and coding polynucleotides derived from the same source, but arranged in a manner different from that found in nature. In some embodiments of the invention, the chimeric construct, chimeric gene, chimeric polynucleotide or chimeric nucleic acid comprises an expression cassette comprising a polynucleotide of the invention under the control of regulatory polynucleotides, particularly under the control of regulatory polynucleotides functional in plants or bacteria.

A "coding sequence" is a nucleic acid sequence that is transcribed into RNA such as mRNA, rRNA, tRNA, snRNA, sense RNA or antisense RNA. Preferably the RNA is then translated in an organism to produce a protein.

As used herein, a "codon optimized" sequence means a nucleotide sequence wherein the codons are chosen to reflect the particular codon bias that a host cell or organism may have. This is typically done in such a way so as to preserve the amino acid sequence of the polypeptide encoded by the nucleotide sequence to be optimized. In certain embodiments, the DNA sequence of the recombinant DNA construct includes sequence that has been codon optimized for the cell (e.g., an animal, plant, or fungal cell) in which the construct is to be expressed. For example, a construct to be expressed in a plant cell can have all or parts of its sequence (e.g., the first gene suppression element or the gene expression element) codon optimized for expression in a plant. See, for example, U.S. Pat. No. 6,121,014, incorporated herein by reference.

The terms "comprises" or "comprising," when used in this specification, specify the presence of stated features, integers, steps, operations, elements, or components, but do not preclude the presence or addition of one or more other features, integers, steps, operations, elements, components, or groups thereof.

As used herein, the transitional phrase "consisting essentially of" (and grammatical variants) means that the scope of a claim is to be interpreted to encompass the specified materials or steps recited in the claim" and those that do not materially alter the basic and novel characteristic(s)" of the claimed invention. Thus, the term "consisting essentially of" when used in a claim of this invention is not intended to be interpreted to be equivalent to "comprising."

In the context of the invention, "corresponding to" or "corresponds to" means that when the amino acid sequences of variant or homolog SDPS, the amino acids that "correspond to" certain enumerated positions in the variant or homolog protein are those that align with these positions in a reference protein but that are not necessarily in these exact numerical positions relative to the particular reference amino acid sequence of the invention.

The term "domain" refers to a set of amino acids conserved at specific positions along an alignment of sequences of evolutionarily related proteins. While amino acids at other positions can vary between homologues, amino acids that are highly conserved at specific positions indicate amino acids that are likely essential in the structure, stability or function of a protein. Identified by their high degree of conservation in aligned sequences of a family of protein homologues, they can be used as identifiers to determine if any polypeptide in question belongs to a previously identified polypeptide group.

"Expression cassette" as used herein means a nucleic acid molecule capable of directing expression of at least one polynucleotide of interest, such as a polynucleotide that encodes a SDPS, in an appropriate host cell, comprising a promoter operably linked to the polynucleotide of interest which is operably linked to a termination signal. An "expression cassette" also typically comprises additional polynucleotides required for proper translation of the polynucleotide of interest. The expression cassette may also comprise other polynucleotides not necessary in the direct expression of a polynucleotide of interest but which are present due to convenient restriction sites for removal of the cassette from an expression vector. The expression cassette comprising the polynucleotide(s) of interest may be chimeric, meaning that at least one of its components is heterologous with respect to at least one of its other components. The expression cassette may also be one that is naturally occurring but has been obtained in a recombinant form useful for heterologous expression. Typically, however, the expression cassette is heterologous with respect to the host, i.e. the polynucleotide of interest in the expression cassette does not occur naturally in the host cell and must have been introduced into the host cell or an ancestor of the host cell by a transformation process or a breeding process. The expression of the polynucleotide(s) of interest in the expression cassette is generally under the control of a promoter. In the case of a multicellular organism, such as a plant, the promoter can also be specific or preferential to a particular tissue, or organ, or stage of development. An expression cassette, or fragment thereof, can also be referred to as "inserted polynucleotide" or "insertion polynucleotide" when transformed into a plant.

As used herein, "full-length sequence" in reference to a specified polynucleotide means having the entire nucleic acid sequence of a native or mutated SDPS sequence. "Native sequence" is intended to mean an endogenous sequence, i.e., a non-engineered sequence found in an organism's genome.

Thus, a fragment of a nucleotide sequence of the invention may encode a biologically active portion of a SDPS polypeptide, or it may be a fragment that can be used as a hybridization probe etc. or PCR primer using methods disclosed below. A biologically active portion of a mutant SDPS polypeptide can be prepared by isolating a portion of one of the nucleotide sequences of the invention, expressing the encoded portion of the mutant SDPS protein (e.g., by recombinant expression in vitro), and assessing the activity of the encoded portion of the mutant SDPS protein. Nucleic acid molecules that are fragments of a nucleotide sequence of the invention comprise at least 15, 20, 50, 75, 100, 150, 200, 300, 400, 500, 600, 700, 800, 900, 1000, 1100, 1200, or 1300 contiguous nucleotides, or up to the number of nucleotides present in a full-length nucleotide sequence disclosed herein.

"Variants" is intended to mean substantially similar sequences. For polynucleotides, a variant comprises a deletion and/or addition of one or more nucleotides at one or more internal sites within the reference polynucleotide and/or a substitution of one or more nucleotides at one or more sites in the mutant SDPS polynucleotide. As used herein, a "reference" polynucleotide or polypeptide comprises a SDPS nucleotide sequence or amino acid sequence, respectively. As used herein, a "native" polynucleotide or polypeptide comprises a naturally occurring nucleotide sequence or amino acid sequence, respectively. One of skill in the art will recognize that variants of the nucleic acids of the invention will be constructed such that the open reading frame is maintained. For polynucleotides, conservative variants include those sequences that, because of the degeneracy of the genetic code, encode the amino acid sequence of one of the mutant SDPS polypeptides of the invention. Naturally occurring allelic variants such as these can be identified with the use of well-known molecular biology techniques, as, for example, with polymerase chain reaction (PCR) and hybridization techniques as outlined below. Variant polynucleotides also include synthetically derived polynucleotide, such as those generated, for example, by using site-directed mutagenesis but which still encode a mutant SDPS protein of the invention. Generally, variants of a particular polynucleotide of the invention will have at least about 40%, 45%, 50%, 55%, 60%, 65%, 70%, 75%, 80%, 85%, 90%, 91%, 92%, 93%, 94%, 95%, 96%, 97%, 98%, 99% or more sequence identity to that particular polynucleotide as determined by sequence alignment programs and parameters described elsewhere herein.

Variants of a particular polynucleotide of the invention (i.e., the reference polynucleotide) can also be evaluated by comparison of the percent sequence identity between the polypeptide encoded by a variant polynucleotide and the polypeptide encoded by the reference polynucleotide. Percent sequence identity between any two polypeptides can be calculated using sequence alignment programs and parameters described elsewhere herein. Where any given pair of polynucleotides of the invention is evaluated by comparison of the percent sequence identity shared by the two polypeptides they encode, the percent sequence identity between the two encoded polypeptides is at least about 40%, 45%, 50%, 55%, 60%, 65%, 70%, 75%, 80%, 85%, 90%, 91%, 92%, 93%, 94%, 95%, 96%, 97%, 98%, 99% or more sequence identity across the entirety of the glucosyl transferase sequences described herein.

"Variant" protein is intended to mean a protein derived from the reference protein by deletion or addition of one or more amino acids at one or more internal sites in the SDPS protein and/or substitution of one or more amino acids at one or more sites in the SDPS protein. Variant proteins encompassed by the present invention are biologically active, that is they continue to possess the desired biological activity of the SDPS protein, that is, SDPS enzymatic activity as described herein. Such variants may result from, for example, genetic polymorphism or from human manipulation. Biologically active variants of a mutant SDPS protein of the invention will have at least about 40%, 45%, 50%, 55%, 60%, 65%, 70%, 75%, 80%, 85%, 90%, 91%, 92%, 93%, 94%, 95%, 96%, 97%, 98%, 99% or more sequence identity across the entirety of the amino acid sequence for the mutant SDPS protein as determined by sequence alignment programs and parameters described elsewhere herein. A biologically active variant of a protein of the invention may differ from that protein by as few as 1-15 amino acid residues, as few as 1-10, such as 6-10, as few as 5, as few as 4, 3, 2, or even 1 amino acid residue. For example, a variant amino acid sequence described as F227L would include the replacement of the phenylalanine residue at position 227 with a leucine residue.

A "gene" is defined herein as a hereditary unit comprising one or more polynucleotides that occupies a specific location on a chromosome or plasmid and that contains the genetic instruction for a particular characteristic or trait in an organism.

The term "heterologous" when used in reference to a gene or a polynucleotide or a polypeptide refers to a gene or a polynucleotide or a polypeptide that is or contains a part thereof not in its natural environment (i.e., has been altered by the hand of man). For example, a heterologous gene may include a polynucleotide from one species introduced into another species. A heterologous gene may also include a polynucleotide native to an organism that has been altered in some way (e.g., mutated, added in multiple copies, linked to a non-native promoter or enhancer polynucleotide, etc.). Heterologous genes further may comprise plant gene polynucleotides that comprise cDNA forms of a plant gene; the cDNAs may be expressed in either a sense (to produce mRNA) or anti-sense orientation (to produce an anti-sense RNA transcript that is complementary to the mRNA transcript). In one aspect of the invention, heterologous genes are distinguished from endogenous plant genes in that the heterologous gene polynucleotide are typically joined to polynucleotides comprising regulatory elements such as promoters that are not found naturally associated with the gene for the protein encoded by the heterologous gene or with plant gene polynucleotide in the chromosome, or are associated with portions of the chromosome not found in nature (e.g., genes expressed in loci where the gene is not normally expressed). Further, a "heterologous" polynucleotide refers to a polynucleotide not naturally associated with a host cell into which it is introduced, including non-naturally occurring multiple copies of a naturally occurring polynucleotide.

"Homologous recombination" is the exchange ("crossing over") of DNA fragments between two DNA molecules or chromatids of paired chromosomes in a region of identical polynucleotides. A "recombination event" is herein understood to mean a meiotic crossing-over.

A nucleic acid sequence is "isocoding" with a reference nucleic acid sequence when the nucleic acid sequence encodes a polypeptide having the same amino acid sequence as the polypeptide encoded by the reference nucleic acid sequence.

The term "isolated" nucleic acid molecule, polynucleotide or protein is a nucleic acid molecule, polynucleotide or protein that no longer exists in its natural environment. An isolated nucleic acid molecule, polynucleotide or protein of the invention may exist in a purified form or may exist in a recombinant host such as in a transgenic bacteria or a transgenic plant. Therefore, a claim to an "isolated" nucleic acid molecule, as enumerated herein, encompasses a nucleic acid molecule when the nucleic acid molecule is comprised within a transgenic plant genome.

A "nucleic acid molecule" is single- or double-stranded DNA or RNA that can be isolated from any source or can made synthetically. In the context of the present invention, the nucleic acid molecule is often a segment of DNA.

"Operably linked" refers to the association of polynucleotides on a single nucleic acid fragment so that the function of one affects the function of the other. For example, a promoter is operably linked with a coding polynucleotide or functional RNA when it is capable of affecting the expression of that coding polynucleotide or functional RNA (i.e., that the coding polynucleotide or functional RNA is under the transcriptional control of the promoter). Coding polynucleotide in sense or antisense orientation can be operably linked to regulatory polynucleotides.

A "plant" is any plant at any stage of development, particularly a seed plant.

A "plant cell" is a structural and physiological unit of a plant, comprising a protoplast and a cell wall. The plant cell may be in the form of an isolated single cell or a cultured cell, or as a part of a higher organized unit such as, for example, plant tissue, a plant organ, or a whole plant.

"Plant cell culture" means cultures of plant units such as, for example. protoplasts, cell culture cells, cells in plant tissues, pollen, pollen tubes, ovules, embryo sacs, zygotes and embryos at various stages of development.

"Plant material" refers to leaves, stems, roots, flowers or flower parts, fruits, pollen, egg cells, zygotes, seeds, cuttings, cell or tissue cultures, or any other part or product of a plant.

A "plant organ" is a distinct and visibly structured and differentiated part of a plant such as a root, stem, leaf, flower bud, or embryo.

"Plant tissue" as used herein means a group of plant cells organized into a structural and functional unit. Any tissue of a plant in planta or in culture is included. This term includes, but is not limited to, whole plants, plant organs, plant seeds, tissue culture and any groups of plant cells organized into structural or functional units. The use of this term in conjunction with, or in the absence of, any specific type of plant tissue as listed above or otherwise embraced by this definition is not intended to be exclusive of any other type of plant tissue.

A "polynucleotide" refers to a polymer composed of many nucleotide monomers covalently bonded in a chain. Such "polynucleotides" includes DNA, RNA, modified oligo nucleotides (e.g., oligonucleotides comprising bases that are not typical to biological RNA or DNA, such as 2'-O-methylated oligonucleotides), and the like. In some embodiments, a nucleic acid or polynucleotide can be single-stranded, double-stranded, multi-stranded, or combinations thereof. Unless otherwise indicated, a particular nucleic acid or polynucleotide of the present invention optionally comprises or encodes complementary polynucleotides, in addition to any polynucleotide explicitly indicated.

"Polynucleotide of interest" refers to any polynucleotide which, when transferred to an organism, e.g., a plant, confers upon the organism a desired characteristic such as insect resistance, disease resistance, herbicide tolerance, antibiotic resistance, improved nutritional value, improved performance in an industrial process, production of commercially valuable enzymes or metabolites or altered reproductive capability.

The term "promoter" refers to a polynucleotide, usually upstream (5') of its coding polynucleotide, which controls the expression of the coding polynucleotide by providing the recognition for RNA polymerase and other factors required for proper transcription.

A "protoplast" is an isolated plant cell without a cell wall or with only parts of the cell wall.

As used herein, the term "recombinant" refers to a form of nucleic acid (e.g., DNA or RNA) or protein or an organism that would not normally be found in nature and as such was created by human intervention. As used herein, a "recombinant nucleic acid molecule" is a nucleic acid molecule comprising a combination of polynucleotides that would not naturally occur together and is the result of human intervention, e.g., a nucleic acid molecule that is comprised of a combination of at least two polynucleotides heterologous to each other, or a nucleic acid molecule that is artificially synthesized, for example, a polynucleotide synthesize using an assembled nucleotide sequence, and comprises a polynucleotide that deviates from the polynucleotide that would normally exist in nature, or a nucleic acid molecule that comprises a transgene artificially incorporated into a host cell's genomic DNA and the associated flanking DNA of the host cell's genome. Another example of a recombinant nucleic acid molecule is a DNA molecule resulting from the insertion of a transgene into a plant's genomic DNA, which may ultimately result in the expression of a recombinant RNA or protein molecule in that organism. As used herein, a "recombinant plant" is a plant that would not normally exist in nature, is the result of human intervention, and contains a transgene or heterologous nucleic acid molecule incorporated into its genome. As a result of such genomic alteration, the recombinant plant is distinctly different from the related wild-type plant.

"Regulatory elements" refer to sequences involved in controlling the expression of a nucleotide sequence. Regulatory elements comprise a promoter operably linked to the nucleotide sequence of interest and termination signals. They also typically encompass sequences required for proper translation of the nucleotide sequence, e.g. introns, 3'UTR, and terminators.

The term "identity" or "identical" or "substantially identical," in the context of two nucleic acid or amino acid sequences, refers to two or more sequences or subsequences that have at least 60%, preferably at least 80%, more preferably 90%, even more preferably 95%, and most preferably at least 99% nucleotide or amino acid residue identity, when compared and aligned for maximum correspondence, as measured using one of the following sequence comparison algorithms or by visual inspection. Preferably, the substantial identity exists over a region of the sequences that is at least about 50 residues or bases in length, more preferably over a region of at least about 100 residues or bases, and most preferably the sequences are substantially identical over at least about 150 residues or bases. In an especially preferred embodiment, the sequences are substantially identical over the entire length of the coding regions. Furthermore, substantially identical nucleic acid or amino acid sequences perform substantially the same function.

For sequence comparison, typically one sequence acts as a reference sequence to which test sequences are compared. When using a sequence comparison algorithm, test and reference sequences are input into a computer, subsequence coordinates are designated if necessary, and sequence algorithm program parameters are designated. The sequence comparison algorithm then calculates the percent sequence identity for the test sequence(s) relative to the reference sequence, based on the designated program parameters.

Optimal alignment of sequences for comparison can be conducted, e.g., by the local homology algorithm of Smith & Waterman, Adv. Appl. Math. 2: 482 (1981), by the homology alignment algorithm of Needleman & Wunsch, J. Mol. Biol. 48: 443 (1970), by the search for similarity method of Pearson & Lipman, Proc. Nat'l. Acad Sci. USA 85: 2444 (1988), by computerized implementations of these algorithms (GAP, BESTFIT, FASTA, and TFASTA in the Wisconsin Genetics Software Package, Genetics Computer Group, 575 Science Dr., Madison, Wis.), or by visual inspection (see generally, Ausubel et al., infra).

One example of an algorithm that is suitable for determining percent sequence identity and sequence similarity is the BLAST algorithm, which is described in Altschul et al., J. Mol. Biol. 215: 403-410 (1990). Software for performing BLAST analyses is publicly available through the National Center for Biotechnology Information (National Center for Biotechnology Information, U.S. National Library of Medicine, 8600 Rockville Pike, Bethesda, MD 20894 USA). This algorithm involves first identifying high scoring sequence pairs (HSN) by identifying short words of length W in the query sequence, which either match or satisfy some positive-valued threshold score T when aligned with a word of the same length in a database sequence. T is referred to as the neighborhood word score threshold (Altschul et al., 1990).

These initial neighborhood word hits act as seeds for initiating searches to find longer HSPs containing them. The word hits are then extended in both directions along each sequence for as far as the cumulative alignment score can be increased. Cumulative scores are calculated using, for nucleotide sequences, the parameters M (reward score for a pair of matching residues; always>0) and N (penalty score for mismatching residues; always<0). For amino acid sequences. a scoring matrix is used to calculate the cumulative score. Extension of the word hits in each direction are halted when the cumulative alignment score falls off by the quantity X from its maximum achieved value, the cumulative score goes to zero or below due to the accumulation of one or more negative-scoring residue alignments, or the end of either sequence is reached. The BLAST algorithm parameters W, T, and X determine the sensitivity and speed of the alignment. The BLASTN program (for nucleotide sequences) uses as defaults a wordlength (W) of 11, an expectation (E) of 10, a cutoff of 100. M=5, N=−4, and a comparison of both strands. For amino acid sequences, the BLASTP program uses as defaults a wordlength (W) of 3, an expectation (E) of 10, and the BLOSUM62 scoring matrix (see Henikoff & Henikoff, Proc. Natl. Acad Sci. USA 89: 10915 (1989)).

In addition to calculating percent sequence identity, the BLAST algorithm also performs a statistical analysis of the similarity between two sequences (see, e.g., Karlin & Altschul, Proc. Nat'l. Acad. Sci. USA 90: 5873-5787 (1993)). One measure of similarity provided by the BLAST algorithm is the smallest sum probability (P(N)), which provides an indication of the probability by which a match between two nucleotide or amino acid sequences would occur by chance. For example, a test nucleic acid sequence is considered similar to a reference sequence if the smallest sum probability in a comparison of the test nucleic acid sequence to the reference nucleic acid sequence is less than about 0.1, more preferably less than about 0.01, and most preferably less than about 0.001.

Another indication that two nucleic acid sequences are substantially identical is that the two molecules hybridize to each other under stringent conditions. The phrase "hybridizing specifically to" refers to the binding, duplexing, or hybridizing of a molecule only to a particular nucleotide sequence under stringent conditions when that sequence is present in a complex mixture (e.g., total cellular) DNA or RNA. "Bind(s) substantially" refers to complementary hybridization between a probe nucleic acid and a target nucleic acid and embraces minor mismatches that can be accommodated by reducing the stringency of the hybridization media to achieve the desired detection of the target nucleic acid sequence.

"Stringent hybridization conditions" and "stringent hybridization wash conditions" in the context of nucleic acid hybridization experiments such as Southern and Northern hybridizations are sequence dependent, and are different under different environmental parameters. Longer sequences hybridize specifically at higher temperatures. An extensive guide to the hybridization of nucleic acids is found in Tijssen (1993) Laboratory Techniques in Biochemistry and Molecular Biology-Hybridization with Nucleic Acid Probes part 1 chapter 2 "Overview of principles of hybridization and the strategy of nucleic acid probe assays" Elsevier, New York. Generally, highly stringent hybridization and wash conditions are selected to be about 5° C. lower than the thermal melting point (Tm) for the specific sequence at a defined ionic strength and pH. Typically, under "stringent conditions" a probe will hybridize to its target subsequence, but not to other sequences.

The Tm is the temperature (under defined ionic strength and pH) at which 50% of the target sequence hybridizes to a perfectly matched probe. Very stringent conditions are selected to be equal to the Tm for a particular probe. An example of stringent hybridization conditions for hybridization of complementary nucleic acids which have more than 100 complementary residues on a filter in a Southern or northern blot is 50% formamide with 1 mg of heparin at 42° C., with the hybridization being carried out overnight. An example of highly stringent wash conditions is 0.15M NaCl at 72° C. for about 15 minutes. An example of stringent wash conditions is a 0.2×SSC wash at 65° C. for 15 minutes (see, Sambrook, infra, for a description of SSC buffer). Often, a high stringency wash is preceded by a low stringency wash to remove background probe signal. An example medium stringency wash for a duplex of, e.g., more than 100 nucleotides, is 1×SSC at 45° C. for 15 minutes. An example low stringency wash for a duplex of, e.g., more than 100 nucleotides, is 4-6×SSC at 40° C. for 15 minutes. For short probes (e.g., about 10 to 50 nucleotides), stringent conditions typically involve salt concentrations of less than about 1.0 M Na ion, typically about 0.01 to 1.0 M Na ion concentration (or other salts) at pH 7.0 to 8.3, and the temperature is typically at least about 30° C. Stringent conditions can also be achieved with the addition of destabilizing agents such as formamide. In general, a signal to noise ratio of 2× (or higher) than that observed for an unrelated probe in the particular hybridization assay indicates detection of a specific hybridization. Nucleic acids that do not hybridize to each other under stringent conditions are still substantially identical if the proteins that they encode are substantially identical. This occurs, e.g., when a copy of a nucleic acid is created using the maximum codon degeneracy permitted by the genetic code.

The following are examples of sets of hybridization/wash conditions that may be used to clone homologous nucleotide sequences that are substantially identical to reference nucleotide sequences of the present invention: a reference nucleotide sequence preferably hybridizes to the reference nucleotide sequence in 7% sodium dodecyl sulfate (SDS), 0.5 M NaPO4, 1 mM EDTA at 50° C. with washing in 2×SSC, 0.1% SDS at 50° C., more desirably in 7% sodium dodecyl sulfate (SDS), 0.5 M NaPO4, 1 mM EDTA at 50° C. with washing in 1×SSC, 0.1% SDS at 50° C., more desirably still in 7% sodium dodecyl sulfate (SDS), 0.5 M NaPO4, 1 mM EDTA at 50° C. with washing in 0.5×SSC, 0.1% SDS at 50° C., preferably in 7% sodium dodecyl sulfate (SDS), 0.5 M NaPO4, 1 mM EDTA at 50° C. with washing in 0.1×SSC, 0.1% SDS at 50° C., more preferably in 7% sodium dodecyl sulfate (SDS), 0.5 M NaPO4, 1 mM EDTA at 50° C. with washing in 0.1×SSC, 0.1% SDS at 65° C.

A further indication that two nucleic acid sequences or proteins are substantially identical is that the protein encoded by the first nucleic acid is immunologically cross reactive with, or specifically binds to, the protein encoded by the second nucleic acid. Thus, a protein is typically substantially identical to a second protein, for example, where the two proteins differ only by conservative substitutions.

As used herein, a "synthetic polynucleotide" refers to a polynucleotide comprising bases or structural features that are not present in a naturally occurring polynucleotide.

Plants which are substantially "tolerant" to a herbicide when they are subjected to it provide a dose/response curve which is shifted to the right when compared with that provided by similarly subjected non tolerant like plants. Such dose/response curves have "dose" plotted on the x-axis and "percentage kill", "herbicidal effect" etc. plotted on the y-axis. Tolerant plants will typically require at least twice as much herbicide as non-tolerant like plants in order to produce a given herbicidal effect. Plants which are substantially "resistant" to the herbicide exhibit few, if any, necrotic, lytic, chlorotic or other lesions when subjected to the herbicide at concentrations and rates which are typically employed by the agricultural community to kill weeds in the field.

"Transformation" is a process for introducing heterologous nucleic acid into a host cell or organism. In particular, "transformation" means the stable integration of a DNA molecule into the genome of an organism of interest.

"Transformed/transgenic/recombinant" refer to a host organism such as a bacterium or a plant into which a heterologous nucleic acid molecule has been introduced. The nucleic acid molecule can be stably integrated into the genome of the host or the nucleic acid molecule can also be present as an extrachromosomal molecule. Such an extrachromosomal molecule can be auto-replicating. Transformed cells, tissues, or plants are understood to encompass not only the end product of a transformation process, but also transgenic progeny thereof. A "non-transformed", "non-transgenic", or "non-recombinant" host refers to a wild-type organism, e.g., a bacterium or plant, which does not contain the heterologous nucleic acid molecule.

For example, once an herbicide-resistance conferring SDPS polynucleotide. alone or in combination with one or more additional nucleic acid molecules encoding polypeptides that confer desirable traits, has been cloned into an expression system, it is transformed into a plant cell. The receptor and target expression cassettes of the present invention can be introduced into the plant cell in a number of art-recognized ways. The term "introducing" in the context of a polynucleotide, for example, a nucleotide construct of interest, is intended to mean presenting to the plant the polynucleotide in such a manner that the polynucleotide gains access to the interior of a cell of the plant. Where more than one polynucleotide is to be introduced, these polynucleotides can be assembled as part of a single nucleotide construct, or as separate nucleotide constructs, and can be located on the same or different transformation vectors. Accordingly, these polynucleotides can be introduced into the host cell of interest in a single transformation event, in separate transformation events, or, for example, in plants, as part of a breeding protocol. The methods of the invention do not depend on a particular method for introducing one or more polynucleotides into a plant, only that the polynucleotide(s) gains access to the interior of at least one cell of the plant. Methods for introducing polynucleotides into plants are known in the art including, but not limited to, transient transformation methods, stable transformation methods, and virus-mediated methods.

"Transient transformation" in the context of a polynucleotide is intended to mean that a polynucleotide is introduced into the plant and does not integrate into the genome of the plant.

By "stably introducing" or "stably introduced" in the context of a polynucleotide introduced into a plant is intended the introduced polynucleotide is stably incorporated into the plant genome, and thus the plant is stably transformed with the polynucleotide.

"Stable transformation" or "stably transformed" is intended to mean that a polynucleotide, for example, a nucleotide construct described herein, introduced into a plant integrates into the genome of the plant and is capable of being inherited by the progeny thereof, more particularly, by the progeny of multiple successive generations.

Numerous transformation vectors available for plant transformation are known to those of ordinary skill in the plant transformation arts, and the genes pertinent to this invention can be used in conjunction with any such vectors. The selection of vector will depend upon the preferred transformation technique and the target species for transformation. For certain target species, different antibiotic or herbicide selection markers may be preferred. Selection markers used routinely in transformation include the nptll gene, which confers resistance to kanamycin and related antibiotics (Messing & Vierra Gene 19: 259-268 (1982); Bevan et al., Nature 304:184-187 (1983)), the pat and bar genes, which confer resistance to the herbicide glufosinate (also called phosphinothricin; see White et al., Nucl. Acids Res 18: 1062 (1990), Spencer et al. Theor. Appl. Genet 79: 625-631 (1990) and U.S. Pat. Nos. 5,561,236 and 5,276,268), the hph gene, which confers resistance to the antibiotic hygromycin (Blochinger & Diggelmann, Mol. Cell Biol. 4: 2929-2931), and the dhfr gene, which confers resistance to methatrexate (Bourouis et al., EMBO J. 2(7): 1099-1104 (1983)), the EPSPS gene, which confers resistance to glyphosate (U.S. Pat. Nos. 4,940,935 and 5,188,642), the glyphosate N-acetyltransferase (GAT) gene, which also confers resistance to glyphosate (Castle et al. (2004) Science, 304: 1151-1154; U.S. Patent App. Pub. Nos. 20070004912, 20050246798, and 20050060767); and the mannose-6-phosphate isomerase gene, which provides the ability to metabolize mannose (U.S. Pat. Nos. 5,767,378 and 5,994,629). Alternatively, and in one preferred embodiment the SDPS gene of the current invention is, in combination with the use of a suitable substrate PSII herbicide as selection agent, itself used as the selectable marker.

Methods for regeneration of plants are also well known in the art. For example, Ti plasmid vectors have been utilized for the delivery of foreign DNA, as well as direct DNA uptake, liposomes, electroporation, microinjection, and microprojectiles. In addition, bacteria from the genus *Agrobacterium* can be utilized to transform plant cells. Below are descriptions of representative techniques for transforming both dicotyledonous and monocotyledonous plants, as well as a representative plastid transformation technique.

Many vectors are available for transformation using *Agrobacterium tumefaciens*. These typically carry at least one T-DNA border sequence and include vectors such as pBIN19 (Bevan, Nucl. Acids Res. (1984)). For the construction of vectors useful in *Agrobacterium* transformation, sec. for example, US Patent Application Publication No. 2006/0260011, herein incorporated by reference.

Transformation without the use of *Agrobacterium tumefaciens* circumvents the requirement for T-DNA sequences in the chosen transformation vector and consequently vectors lacking these sequences can be utilized in addition to vectors such as the ones described above which contain T-DNA sequences. Transformation techniques that do not rely on *Agrobacterium* include transformation via particle bombardment, protoplast uptake (e.g. PEG and electroporation) and microinjection. The choice of vector depends largely on the preferred selection for the species being transformed. For the construction of such vectors, see, for example, US Application No. 20060260011, herein incorporated by reference.

Transformation techniques for dicotyledons are well known in the art and include *Agrobacterium*-based techniques and techniques that do not require *Agrobacterium*. Non-*Agrobacterium* techniques involve the uptake of exogenous genetic material directly by protoplasts or cells. This can be accomplished by PEG or electroporation mediated uptake, particle bombardment-mediated delivery, or microinjection. Examples of these techniques are described by Paszkowski et al., EMBO J. 3: 2717-2722 (1984), Potrykus et al., Mol. Gen. Genet. 199: 169-177 (1985), Reich et al., Biotechnology 4: 1001-1004 (1986), and Klein et al., Nature 327: 70-73 (1987). In each case the transformed cells are regenerated to whole plants using standard techniques known in the art.

*Agrobacterium*-mediated transformation is a preferred technique for transformation of dicotyledons because of its high efficiency of transformation and its broad utility with many different species. *Agrobacterium* transformation typically involves the transfer of the binary vector carrying the foreign DNA of interest (e.g. pCIB200 or pCIB2001) to an appropriate *Agrobacterium* strain which may depend of the complement of vir genes carried by the host *Agrobacterium* strain either on a co-resident Ti plasmid or chromosomally (e.g. strain CIB542 for pCIB200 and pCIB2001 (Uknes et al. Plant Cell 5: 159-169 (1993)). The transfer of the recombinant binary vector to *Agrobacterium* is accomplished by a triparental mating procedure using *E. coli* carrying the recombinant binary vector, a helper *E. coli* strain which carries a plasmid such as pRK2013 and which is able to mobilize the recombinant binary vector to the target *Agrobacterium* strain. Alternatively, the recombinant binary vector can be transferred to *Agrobacterium* by DNA transformation (Hofgen & Willmitzer, Nucl. Acids Res. 16: 9877 (1988)).

Transformation of the target plant species by recombinant *Agrobacterium* usually involves co-cultivation of the *Agro-*

*bacterium* with explants from the plant and follows protocols well known in the art. Transformed tissue is regenerated on selectable medium carrying the antibiotic or herbicide resistance marker present between the binary plasmid T-DNA borders.

Another approach to transforming plant cells with a gene involves propelling inert or biologically active particles at plant tissues and cells. This technique is disclosed in U.S. Pat. Nos. 4,945,050, 5,036,006, and 5,100,792 all to Sanford et al. Generally, this procedure involves propelling inert or biologically active particles at the cells under conditions effective to penetrate the outer surface of the cell and afford incorporation within the interior thereof. When inert particles are utilized, the vector can be introduced into the cell by coating the particles with the vector containing the desired gene. Alternatively, the target cell can be surrounded by the vector so that the vector is carried into the cell by the wake of the particle. Biologically active particles (e.g., dried yeast cells, dried bacterium or a bacteriophage, each containing DNA sought to be introduced) can also be propelled into plant cell tissue.

Transformation of most monocotyledon species has now also become routine. Preferred techniques include direct gene transfer into protoplasts using PEG or electroporation techniques, and particle bombardment into callus tissue. Patent Applications EP 0 292 435, EP 0 392 225, and WO 93/07278 describe techniques for the preparation of callus and protoplasts from an elite inbred line of maize, transformation of protoplasts using PEG or electroporation, and the regeneration of maize plants from transformed protoplasts. Gordon-Kamm et al. (Plant Cell 2: 603-618 (1990)) and Fromm et al. (Biotechnology 8: 833-839 (1990)) have published techniques for transformation of A188-derived maize line using particle bombardment. Furthermore, WO 93/07278 and Koziel et al. (Biotechnology 11: 194-200 (1993)) describe techniques for the transformation of elite inbred lines of maize by particle bombardment. This technique utilizes immature maize embryos of 1.5-2.5 mm length excised from a maize car 14-15 days after pollination and a PDS-1000He Biolistics device for bombardment.

Transformation of rice can also be undertaken by direct gene transfer techniques utilizing protoplasts or particle bombardment. Protoplast-mediated transformation has been described for *Japonica*-types and Indica-types (Zhang et al. Plant Cell Rep 7: 379-384 (1988); Shimamoto et al. Nature 338: 274-277 (1989); Datta et al. Biotechnology 8:736-740 (1990)). Both types are also routinely transformable using particle bombardment (Christou et al. Biotechnology 9: 957-962 (1991)). Furthermore, WO 93/21335 describes techniques for the transformation of rice via electroporation.

Transformation of monocotyledons using *Agrobacterium* has also been described. See, WO 94/00977 and U.S. Pat. No. 5,591,616, both of which are incorporated herein by reference. See also, Negrotto et al., Plant Cell Reports 19: 798-803 (2000), incorporated herein by reference.

The plants obtained via transformation with a nucleic acid sequence of interest in the present invention can be any of a wide variety of plant species, including those of monocots and dicots; however, the plants used in the method of the invention are preferably selected from the list of agronomically important target crops set forth elsewhere herein. The expression of a gene of the present invention in combination with other characteristics important for production and quality can be incorporated into plant lines through breeding. Breeding approaches and techniques are known in the art. See, for example, Welsh J. R., Fundamentals of Plant Genetics and Breeding, John Wiley & Sons, NY (1981); Crop Breeding, Wood D. R. (Ed.) American Society of Agronomy Madison, Wis. (1983); Mayo O., The Theory of Plant Breeding, Second Edition, Clarendon Press, Oxford (1987); Singh, D. P., Breeding for Resistance to Diseases and Insect Pests. Springer-Verlag, NY (1986); and Wricke and Weber, Quantitative Genetics and Selection Plant Breeding, Walter de Gruyter and Co., Berlin (1986).

Nucleotides are indicated herein by the following standard abbreviations: adenine (A), cytosine (C), thymine (T), and guanine (G). Amino acids are likewise indicated by the following standard abbreviations: alanine (Ala; A), arginine (Arg; R), asparagine (Asn; N), aspartic acid (Asp; D), cysteine (Cys; C), glutamine (Gln; Q), glutamic acid (Glu; E), glycine (Gly; G), histidine (His; H), isoleucine (Ile; I), leucine (Leu; L), lysine (Lys; K), methionine (Met; M), phenylalanine (Phe; F), proline (Pro; P), serine (Ser; S), threonine (Thr; T), tryptophan (Trp; W), tyrosine (Tyr; Y), and valine (Val; V).

The present disclosure provides, inter alia, compositions and methods for selectively controlling weeds at a locus. The invention further relates to recombinant DNA technology, and in particular to the production of transgenic plants which exhibit substantial resistance or substantial tolerance to herbicides when compared with non-transgenic like plants. Plants which are substantially "tolerant" to a herbicide when they are subjected to it provide a dose/response curve which is shifted to the right when compared with that provided by similarly subjected non tolerant like plants. Such dose/response curves have "dose" plotted on the x-axis and "percentage kill", "herbicidal effect" etc. plotted on the y-axis. Tolerant plants will typically require at least twice as much herbicide as non-tolerant like plants in order to produce a given herbicidal effect. Plants which are substantially "resistant" to the herbicide exhibit few, if any, necrotic, lytic, chlorotic or other lesions when subjected to the herbicide at concentrations and rates which are typically employed by the agricultural community to kill weeds in the field.

Tolerance to Solanesyl Diphosphate Synthase (SDPS) inhibiting herbicides in plants has not been reported as it has not previously been recognised as the target site for certain classes of herbicidal compounds. Transgenic plants overexpressing a Solanesyl Diphosphate Synthase gene or variants of are tolerant of the described herbicides. Further, native SDPS genes can be edited in plants to confer tolerance to the described herbicides. The present disclosure thus provides, inter alia, an opportunity to utilise Solanesyl Diphosphate Synthase-inhibiting herbicides in a broader agricultural context.

Thus, according to one aspect of the present disclosure there is provided a method of selectively controlling weeds at a locus comprising crop plants and weeds, the method comprising applying to the locus a weed controlling amount of a pesticide composition comprising a SDPS-inhibiting herbicide, wherein the crop plants are modified such that they comprise a SDPS which provides the crop plant with tolerance against the SDPS-inhibiting herbicide.

For the purposes of the present invention a SDPS-inhibiting herbicide is one which inhibits *Arabidopsis* SDPS i.e. exhibits an IC50 less than 10 μM, preferably 5 μM in the assay method as set out herein.

In one such embodiment, the SDPS-inhibiting herbicide is a compound of formula (I): In one such embodiment, the SDPS-inhibiting herbicide is a compound of formula (I):

(I)

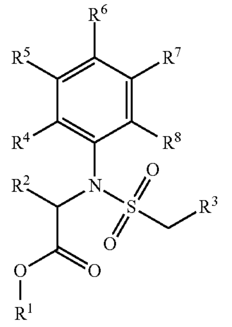

wherein $R^1$ is selected from the group consisting of $C_1$-$C_6$alkyl, $C_1$-$C_6$ haloalkyl, $C_2$-$C_6$ alkynyl and $C_2$-$C_6$ alkenyl;

$R^2$ is $C_1$-$C_2$alkyl;

$R^3$ is selected from the group consisting of $C_1$-$C_5$ alkyl, $C_1$-$C_5$ haloalkyl, halogen, CN, —$CH_2$OMe, substituted aryl, substituted 5-6 membered heteroaryl and 4-6 membered heterocyclyl;

$R^4$ to $R^8$ are independently selected from the group consisting of H, Me, $CF_3$, halogen, $CF_3$ and CN wherein a minimum of two $R^4$ to $R^8$ are not hydrogen and a maximum of three of $R^4$ to $R^8$ are not hydrogen.

Exemplary compounds of formula (I) include Herbicide Compound Ex. 1 and Herbicide Compound Ex. 2 shown below:

Herbicide Compound Ex. 1:

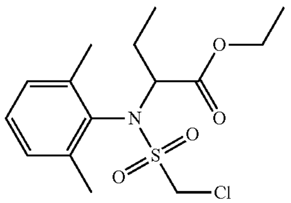 [SMILES: CCOC(=O)C(CC)N(c1c(C)cccc1C)S(=O)(=O)CCl]

Herbicide Compound Ex. 2:

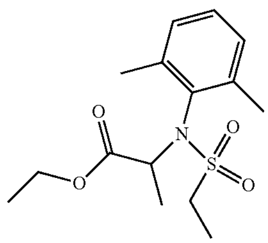 [SMILES: CCOC(=O)C(C)N(c1c(C)cccc1C)S(=O)(=O)CC]

In another embodiment of the present invention, the SDPS-inhibiting herbicide is a compound of Formula (1) directly below

1

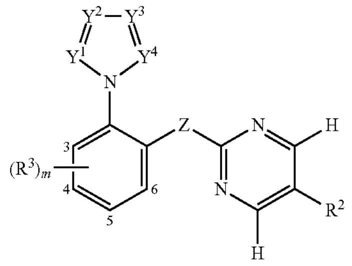

as disclosed in WO2015/089003, the entire contents of which are incorporated by reference herein.

In another embodiment of the present invention, the SDPS-inhibiting herbicide is a compound disclosed in WO2015/108779. Thus, in this embodiment the SDPS-inhibiting herbicide is a compound of (1)

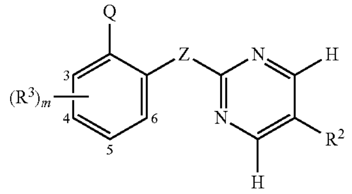

wherein

Q is a 5- or 6-membered aromatic heterocylic ring, bound to the remainder of Formula 1 through a carbon atom, and optionally substituted with 1 to 4 $R^1$;

Z is O or S;

each $R^1$ is independently halogen, cyano, nitro, $SF_5$, CHO, C(═O)$NH_2$, C(═S)$NH_2$, $SO_2NH_2$, $C_1$-$C_4$ alkyl, $C_2$-$C_4$ alkenyl, $C_2$-$C_4$ alkynyl, $C_1$-$C_4$ haloalkyl, $C_2$-$C_4$ haloalkenyl, $C_2$-$C_4$ haloalkynyl, $C_5$-$C_6$ cycloalkyl, $C_3$-$C_6$ halocycloalkyl, $C_4$-$C_8$ alkylcycloalkyl, $C_4$-$C_8$ cycloalkylalkyl, $C_2$-$C_8$ alkylcarbonyl, $C_2$-$C_6$ haloalkylcarbonyl, $C_2$-$C_6$ alkoxycarbonyl, $C_3$-$C_7$ cycloalkylcarbonyl, $C_2$-$C_6$ alkylaminocarbonyl, $C_3$-$C_{10}$ dialkylaminocarbonyl, $C_1$-$C_4$ alkoxy, $C_3$-$C_4$ alkenyloxy, $C_3$-$C_4$ alkynyloxy, $C_1$-$C_4$ haloalkoxy, $C_3$-$C_4$ haloalkenyloxy, $C_3$-$C_4$ haloalkynyloxy, $C_5$-$C_6$ cycloalkoxy, $C_3$-$C_6$ halocycloalkoxy, $C_4$-$C_8$ cycloalkylalkoxy. $C_2$-$C_6$ alkoxyalkyl, $C_2$-$C_6$ haloalkoxyalkyl, $C_2$-$C_6$ alkoxyhaloalkyl, $C_2$-$C_6$ alkoxyalkoxy, $C_2$-$C_4$ alkylcarbonyloxy, $C_2$-$C_6$ cyanoalkyl, $C_2$-$C_6$ cyanoalkoxy, $C_1$-$C_4$ hydroxyalkyl, $C_2$-$C_4$ alkylthioalkyl, SOn$R^{1A}$, Si$(CH_3)_3$ or B(—OC$(R^{1B})$2C$(R^{1B})_2$O—); or a phenyl ring optionally substituted with up to 5 substituents independently selected from $R^{1C}$; or a 5- or 6-membered heteroaromatic ring containing ring members selected from carbon atoms and up to 4 heteroatoms independently selected from up to 2 O, up to 2 S and up to 4 N atoms, each ring optionally substituted with up to 3 substituents independently selected from $R^{1C}$ on carbon atom ring members and $R^{1D}$ on nitrogen atom ring members;

$R^2$ is halogen, cyano, nitro, $C_1$-$C_4$ alkoxy, $C_1$-$C_4$ alkyl, $C_2$-$C_6$ alkenyl, $C_2$-$C_5$ alkynyl, SOn$R^{2A}$, $C_1$-$C_4$ haloalkyl or $C_5$-$C_6$ cycloalkyl;

each $R^3$ is independently halogen, cyano, hydroxy, nitro, amino, CHO, C(═O)$NH_2$, C(═S)$NH_2$, $SO_2NH_2$, $C_1$-$C_4$ alkyl, $C_2$-$C_4$ alkenyl, $C_2$-$C_4$ alkynyl, $C_1$-$C_4$ haloalkyl, $C_2$-$C_4$ haloalkenyl, $C_2$-$C_4$ haloalkynyl, $C_3$-$C_6$ cycloalkyl, $C_5$-$C_6$ halocycloalkyl, $C_4$-$C_8$ alkylcycloalkyl, $C_4$-$C_8$ cycloalkylalkyl, $C_2$-$C_8$ alkylcarbonyl, $C_2$-$C_6$ haloalkylcarbonyl, $C_2$-$C_6$ alkoxycarbonyl, $C_3$-$C_7$ cycloalkylcarbonyl, $C_1$-$C_4$ alkoxy, $C_5$-$C_4$ alkenyloxy, $C_3$-$C_4$ alkynyloxy, $C_1$-$C_4$ haloalkoxy, $C_3$-$C_4$ haloalkenyloxy, $C_3$-$C_4$ haloalkynyloxy, $C_3$-$C_6$ cycloalkoxy, $C_3$-$C_6$ halocycloalkoxy, $C_4$-$C_8$ cycloalkylalkoxy, $C_2$-$C_6$ alkoxyalkyl, $C_2$-$C_6$ haloalkoxyalkyl, $C_2$-$C_6$ alkoxyhaloalkyl, $C_2$-$C_6$ alkoxyalkoxy, $C_2$-$C_4$ alkylcarbonyloxy, $C_2$-$C_6$ cyanoalkyl, $C_2$-$C_6$ cyanoalkoxy, $C_2$-$C_4$ alkylthioalkyl, $Si(CH_3)_3$, $C{\equiv}CSi(CH_3)_3$, $C(=O)N(R^{3A})(R^{3B})$, $C(=NOR^{3C})H$, $C(=N^{R3D})H$, $SOnR^{3E}$; or a phenyl ring optionally substituted with up to 5 substituents independently selected from $R^{3F}$; or a 5- or 6-membered heteroaromatic ring containing ring members selected from carbon atoms and up to 4 heteroatoms independently selected from up to 2 O, up to 2 S and up to 4 N atoms, each ring optionally substituted with up to 3 substituents independently selected from R” on carbon atom ring members and $R^{3G}$ on nitrogen atom ring members; or pyrimidinyloxy;

m is 0, 1, 2 or 3;

each n is independently 0, 1 or 2;

each $R^{1A}$, $R^{2A}$ and $R^{3E}$ is independently $C_1$-$C_4$ alkyl, $C_1$-$C_4$ haloalkyl, $C_1$-$C_4$ alkylamino or C2-C6 dialkylamino;

each $R^{1B}$ is independently H or $C_1$-$C_4$ alkyl;

each $R^{1C}$ is independently hydroxy, halogen, cyano, nitro, $C_1$-$C_6$ alkyl, $C_1$-$C_6$ haloalkyl, C1-C6 alkoxy or C1-C6 haloalkoxy;

each $R^{1D}$ is independently cyano, $C_1$-$C_6$ alkyl, $C_1$-$C_6$ haloalkyl, $C_1$-$C_6$ alkoxy or $C_2$ $C_6$-alkylcarbonyl;

each $R^{3A}$ is independently $C_1$-$C_4$ alkyl or $C_1$-$C_4$ haloalkyl;

each $R^{3B}$ is independently H, $C_1$-$C_4$ alkyl or $C_1$-$C_4$ haloalkyl;

each $R^{3C}$ is independently H or $C_1$-$C_4$ alkyl;

each $R^{3D}$ is independently H, amino, $C_1$-$C_4$ alkyl or $C_1$-$C_4$ alkylamino;

each $R^{3F}$ is independently hydroxy, halogen, cyano, nitro, $C_1$-$C_6$ alkyl, $C_1$-$C_6$ haloalkyl, $C_2$-$C_6$ alkoxy or $C_1$-$C_6$ haloalkoxy; and each $R^{3G}$ is independently cyano, $C_1$-$C_5$ alkyl, $C_1$-$C_6$ haloalkyl, $C_1$-$C_6$ alkoxy or $C_2$-$C_6$ alkylcarbonyl.

In this embodiment, the compound of Formula (1) is preferably selected from the group consisting of 5-[2-chloro-6-(5-chloropyrimidin-2-yl)oxy-phenyl]-3-(difluoromethyl) isoxazole, 5-[2-bromo-6-(5-chloropyrimidin-2-yl)oxy-phenyl]-3-(difluoromethyl)isoxazole and 3-(5-chloropyrimidin-2-yl)oxy-2-[3-(difluoromethyl)isoxazol-5-yl]benzonitrile. More preferably the compound is 5-[2-chloro-6-(5-chloropyrimidin-2-yl)oxy-phenyl]-3-(difluoromethyl)isoxazole.

In another embodiment of the present invention, the SDPS-inhibiting herbicide is a compound of Formula (1) directly below

1

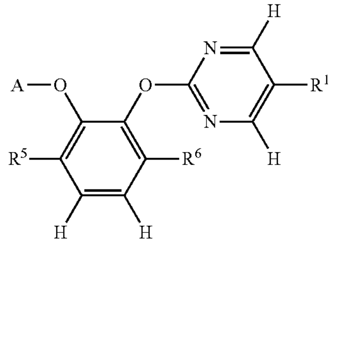

as disclosed in WO2016/010731, the entire contents of which are incorporated by reference herein.

In another embodiment of the present invention, the SDPS-inhibiting herbicide is a compound of the Formula shown directly below

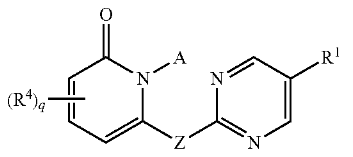

as disclosed in WO2016/014814, the entire contents of which are incorporated by reference herein.

In another embodiment of the present invention, the SDPS-inhibiting herbicide is a compound of Formula (1) directly below

1

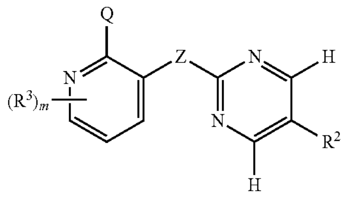

as disclosed in WO2016/149315, the entire contents of which are incorporated by reference herein.

In another embodiment of the present invention, the SDPS-inhibiting herbicide is a compound of Formula (1) disclosed in WO2016/196606. Thus, in this embodiment the SDPS-inhibiting herbicide is compound of Formula(l) (including all geometric and stereoisomers). N-oxides, and salts thereof:

(1)

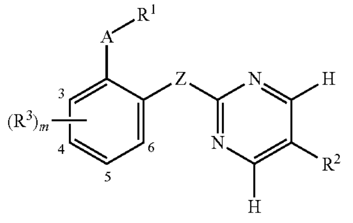

wherein

A is;

A-1

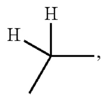

A-2

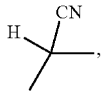

-continued

A-3

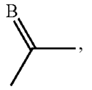

A-4

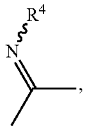

A-5

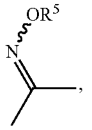

A-6

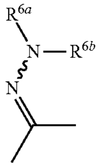

or

A-7

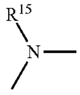

B is O or S;

R1 is H, C1-C6alkyl, C2-C6alkenyl, C2-C6alkynyl, C1-C6haloalkyl, C2-$C_6$haloalkenyl, C2-C6 haloalkynyl, C3-C6 cycloalkyl, C3-C6 halocycloalkyl, C3-C6 halocycloalkylalkyl, C4-C6 alkylcycloalkyl, C4-C6 cycloalkylalkyl, C1-C6 alkylamino, C1-C6 haloalkylamino, C2-C10 dialkylamino, C2-C10 halodialkylamino, C3-C6 cycloamino, C1-C6 alkoxy, C3-C6 alkenyloxy, C3-C6 alkynyloxy, C1-C6 haloalkoxy, C3-C6 haloalkenyloxy, C3-C6 haloalkynyloxy, C3-C6 cycloalkoxy, C3-C6 halocycloalkoxy, C4-C6 cycloalkylalkoxy, C4-C6 halocycloalkylalkoxy, C2-C6 alkoxyalkyl, C2-C6 haloalkoxyalkyl, C2-C6 alkoxyhaloalkyl, C2-C6 alkoxyalkoxy, C2-C6 cyanoalkyl, C2-C6 cyanoalkoxy, C3-C7 cyanoalkoxyalkyl, C1-C6 hydroxyalkyl, C1-C6 nitroalkyl, C1-C6 alkylthio, C1-C6 haloalkylthio, C3-C8 cycloalkylthio, C1-C6 alkenylthio, C1-C6 alkylsulfinyl, C1-C6 haloalkylsulfonyl, C3-C8 cycloalkylsulfonyl, C2-C6 alkylthioalkyl, C2-C6 haloalkylthioalkyl, benzyl, —N(R7)(OR8), —ON(R9a)(R9b) or —N(R7)N(R9a)(R9b);

Z is O or S;

R2 is halogen, cyano, nitro, C1-C6 alkoxy, C1-C6 alkyl, C2-C6 alkenyl, C2-C6 alkynyl, C1-C6haloalkyl, C3-C6cycloalkyl or —SOnR10;

each R3 is independently halogen, cyano, nitro, CHO, C(=O)NH2, C(=S)NH2, SO2NH2, C1-C4alkyl, C2-C4alkenyl, C2-C4alkynyl, C1-C4 haloalkyl, C2-C4haloalkenyl, C2-C4haloalkynyl, C3-C6 cycloalkyl, C3-C6 halocycloalkyl, C4-C6 alkylcycloalkyl, C4-C6 cycloalkylalkyl, C2-C6 alkylcarbonyl, C2-C6 haloalkylcarbonyl, C2-C6 alkoxycarbonyl, C3-C7 cycloalkylcarbonyl, C2-C4alkoxy, C3-$C_4$alkenyloxy, C3-C4alkynyloxy, C1-C4haloalkoxy, C3-C6 cycloalkoxy, C3-C6 halocycloalkoxy, C4-C6 cycloalkylalkoxy, C2-C6 alkoxyalkyl, C2-C6 haloalkoxyalkyl, C2-C6 alkoxyhaloalkyl, C2-C6 alkoxyalkoxy, C2-C4alkylcarbonyloxy, C2-C6 cyanoalkyl, C2-C6 cyanoalkoxy, C2-C4alkylthioalkyl, —C(=O)N(R11a)(R11b), —C(=NOR12)H, —C(=N(R13))H or —SOnR14;

m is 0, 1, 2 or 3;

each n is independently 0, 1 or 2;

R4 is H, C1-C6alkyl or C1-C6haloalkyl;

R5 is H, C1-C6alkyl, C2-C6alkenyl, C2-C6alkynyl, C1-C6haloalkyl, C2-C6 haloalkenyl, C2-C6 haloalkynyl, C3-C6 cycloalkyl, C3-C6 halocycloalkyl, C4-C6 alkylcycloalkyl, C4-C6 cycloalkylalkyl, C2-C6 alkoxyalkyl, C2-C6 haloalkoxyalkyl, C2-C6 alkoxyhaloalkyl, C2-C6 cyanoalkyl, C3-C7 cyanoalkoxyalkyl, C1-C6 hydroxyalkyl, C1-C6 nitroalkyl, C2-C6 alkylthioalkyl, C2-C6 haloalkylthioalkyl or benzyl;

each R6a and R6b is independently H, C1-C6alkyl or C1-C6haloalkyl;

R7 is H, C1-C6alkyl or C1-C6haloalkyl;

R8 is H, C1-C6 alkyl, C1-C6 haloalkyl, C2-C6 alkoxyalkyl, C2-C6 haloalkoxyalkyl or C2-C6 cyanoalkyl;

each R9a and R9b is independently H, C1-C6 alkyl or C1-C6 haloalkyl;

R10 is independently C1-C6 alkyl, C1-C6 haloalkyl, C1-C6 alkylamino or C2-C10 dialkylamino;

each R11a is independently C1-C4 alkyl or C1-C4 haloalkyl;

each R11b is independently H, C1-C4 alkyl or C1-C4 haloalkyl;

each R12 is independently H or C1-C4 alkyl;

each R13 is independently H, amino, C1-C4 alkyl or C1-C4 alkylamino;

each R14 is independently C1-C6 alkyl, C1-C6 haloalkyl, C1-C6 alkylamino or C2-C10 dialkylamino;

and R15 is H or C1-C6alkyl.

In this embodiment, the compound of Formula (1) is preferably selected from the group consisting of 5-chloro-2-[3-chloro-2-(5,5,5-trifluoropentyl)phenoxy]pyrimidine, 2-[3-bromo-2-(5,5,5-trifluoropentyl)phenoxy]-5-chloro-pyrimidine, 3-(5-chloropyrimidin-2-yl)oxy-2-(5,5,5-trifluoropentyl)benzonitrile, 1-[2-chloro-6-(5-chloropyrimidin-2-yl)oxy-phenyl]-4,4,4-trifluoro-butan-1-one, 1-[2-bromo-6-(5-chloropyrimidin-2-yl)oxy-phenyl]-4,4,4-trifluoro-butan-1-one and 3-(5-chloropyrimidin-2-yl)oxy-2-(4,4,4-trifluorobutanoyl)benzonitrile. More preferably, the compound is 1-[2-chloro-6-(5-chloropyrimidin-2-yl)oxy-phenyl]-4,4,4-trifluoro-butan-1-one.

In another embodiment of the present invention, the SDPS-inhibiting herbicide is a compound of Formula (1) directly below

1

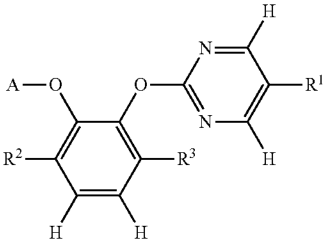

as disclosed in WO2017/011288, the entire contents of which are incorporated by reference herein.

In another embodiment of the present invention, the SDPS-inhibiting herbicide is a compound of Formula (1) directly below

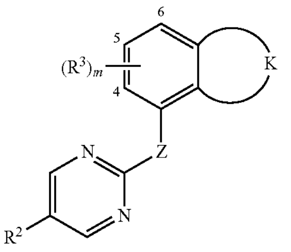

as disclosed in WO2018/204164, the entire contents of which are incorporated by reference herein.

In another embodiment of the present invention, the SDPS-inhibiting herbicide is a compound of the Formula (I) as disclosed in international patent application PCT/EP2019/079971. Thus in this embodiment the SDPS-inhibiting herbicide is a compound of Formula (1)

(I)

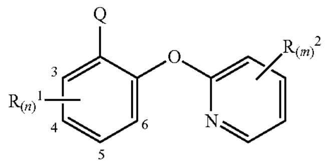

or an agronomically acceptable salt thereof, wherein

Q is a 5-membered aromatic heterocyclic ring which is optionally substituted by 1 or 2 R3 substituents independently selected from the group consisting of C1-C4alkyl, C2-C4alkenyl, C2-C4alkynyl, cyclopropyl, C1-C4haloalkyl, C1-C2alkoxy-, C1-C2haloalkoxy-, halogen, —C(O)C1-C4alkyl, NO2, —CH2CN, —CN and —S(O)pC1-C4alkyl;

each R1 is independently selected from the group consisting of halogen, —CN, nitro, C1-C4alkyl, C2-C4alkenyl, C2-C4alkynyl, C1-C4haloalkyl, C1-C4alkoxy-, C1-C4haloalkoxy- and —S(O)pC1-C4alkyl;

each R2 is independently selected from the group consisting of halogen, —CN, NO2, C1-C4alkyl, C1-C4haloalkyl, C3-C6cycloalkyl C2-C4alkenyl, C2-C4alkynyl, —S(O)pC1-C4alkyl, C1-C4alkoxy, —C(O)C1-C4alkyl, —C(O)OC1-C4alkyl and C1-C4haloalkoxy;

m=0, 1 or 2;

n=0, 1 or 2; and p=0, 1 or 2.

In this embodiment, the compound of Formula (I) is preferably selected from the group consisting of 5-[2-[(5-chloro-3-fluoro-2-pyridyl)oxy]-6-fluoro-phenyl]-3-(difluoromethyl)isoxazole, 5-chloro-3-fluoro-2-[2-[4-(trifluoromethyl)pyrazol-1-yl]phenoxy]pyridine and 5-chloro-2-[2-[3-(difluoromethyl)isoxazol-5-yl]-3-fluoro-phenoxy]pyridine-3-carbonitrile.

In another embodiment of the present invention, the SDPS-inhibiting herbicide is a compound of the Formula shown directly below

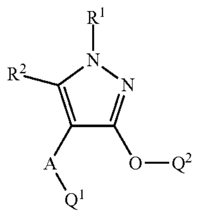

as disclosed in WO2019/016066, the entire contents of which are incorporated by reference herein.

In another embodiment of the present invention, the SDPS-inhibiting herbicide is a compound of Formula (I) directly below (I)

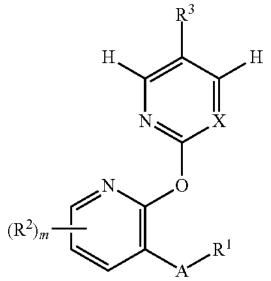

as disclosed in WO2020/002089, the entire contents of which are incorporated by reference herein.

In another embodiment of the present invention, the SDPS-inhibiting herbicide is a compound of Formula (I) directly below (I)

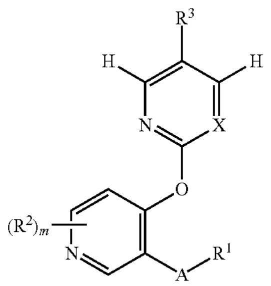

as disclosed in WO2020/002087, the entire contents of which are incorporated by reference herein.

In another embodiment of the present invention, the SDPS-inhibiting herbicide is a compound of Formula (1) directly below (I)

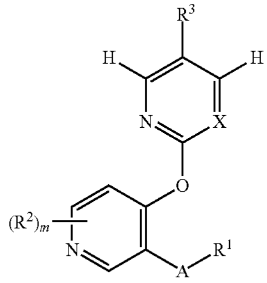

as disclosed in WO2020/002085, there entire contents of which is incorporated by reference herein.

In another embodiment of the present invention, the SDPS-inhibiting herbicide is a compound of Formula (I) directly below

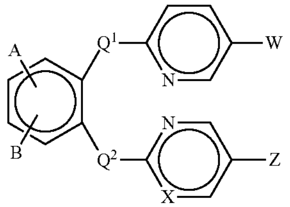

as disclosed in EP 0061913A2, the entire contents of which are incorporated by reference herein.

Where applicable, the SDPS-inhibiting herbicide may be present as a racemate or as a single enantiomer (or an enantiomer-enriched mixture of enantiomers).

It should be understood that in the aforementioned methods the herbicide composition may be applied to the locus pre-emergence of the crop and/or post-emergence of the crop—a so-called "over-the-top" application. In a preferred embodiment the herbicide composition is applied pre-emergence of the crop. Single or indeed multiple applications may be applied as necessary to obtain the desired weed control. The SDPS-inhibiting herbicide may be applied to the locus at any suitable rate. Typically, the genome edited or transgenic plants of the invention exhibit resistance or tolerance to application of the SDPS-inhibiting herbicide in an amount of from about 5 to about 2,000 grams of active ingredient per hectare (g/ha), including, for example, about 5 g/ha, about 10 g/ha, about 15 g/ha, about 20 g/ha, about 25 g/ha, about 30 g/ha, about 35 g/ha, about 40 g/ha, about 45 g/ha, about 50 g/ha, about 55 g/ha, about 60 g/ha, about 65 g/ha, about 70 g/ha, about 75 g/ha, about 80 g/ha, about 85 g/ha, about 90 g/ha, about 95 g/ha, about 100 g/ha, about 110 g/ha, about 120 g/ha, about 130 g/ha, about 140 g/ha, about 150 g/ha, about 160 g/ha, about 170 g/ha, about 180 g/ha, about 190 g/ha, about 200 g/ha, about 210 g/ha, about 220 g/ha, about 230 g/ha, about 240 g/ha, about 250 g/ha, about 260 g/ha, about 270 g/ha, about 280 g/ha, about 290 g/ha, about 300 g/ha, about 310 g/ha, about 320 g/ha, about 330 g/ha, about 340 g/ha, about 350 g/ha, about 360 g/ha, about 370 g/ha, about 380 g/ha, about 390 g/ha, about 400 g/ha, about 410 g/ha, about 420 g/ha, about 430 g/ha, about 440 g/ha, about 450 g/ha, about 460 g/h, about 470 g/ha, about 480 g/ha, about 490 g/ha, about 500 g/ha, about 510 g/ha, about 520 g/ha, about 530 g/ha, about 540 g/ha, about 550 g/ha, about 560 g/ha, about 570 g/ha, about 580 g/ha, about 590 g/ha, about 600 g/ha, about 610 g/ha, about 620 g/ha, about 630 g/ha, about 640 g/ha, about 650 g/ha, about 660 g/ha, about 670 g/ha, about 680 g/ha, about 690 g/ha, about 700 g/ha, about 710 g/ha, about 720 g/ha, about 730 g/ha, about 740 g/ha, about 750 g/ha, about 760 g/ha, about 770 g/ha, about 780 g/ha, about 790 g/ha, about 800 g/ha, about 810 g/ha, about 820 g/ha, about 830 g/ha, about 840 g/ha, about 850 g/ha, about 860 g/ha, about 870 g/ha, about 880 g/ha, about 890 g/ha, about 900 g/ha, about 910 g/ha about 920 g/ha about 930 g/ha, about 940 g/ha, about 950 g/ha, about 960 g/ha, about 970 g/ha about 980 g/ha, about 990 g/ha, about 1,000, g/ha, about 1.010 g/ha, about 1,020 g/ha, about 1,030 g/ha, about 1,040 g/ha, about 1,050 g/ha, about 1.060 g/ha, about 1.070 g/ha, about 1,080 g/ha, about 1,090 g/ha, about 1,100 g/ha, about 1,110 g/ha, about 1,120 g/ha, about 1,130 g/ha, about 1,140 g/ha, about 1,150 g/ha, about 1,160 g/ha, about 1,170 g/ha, about 1,180 g/ha, about 1.190 g/ha, about 1,200 g/ha, about 1,210 g/ha, about 1,220 g/ha, about 1,230 g/ha, about 1,240 g/ha, about 1,250 g/ha, about 1,260 g/ha, about 1,270 g/ha, about 1,280 g/ha, about 1,290 g/ha, about 1,300 g/ha, about 1,310 g/ha, about 1,320 g/ha, about 1,330 g/ha, about 1,340 g/ha, about 1,350 g/ha, about 360 g/ha, about 1,370 g/ha, about 1,380 g/ha, about 1,390 g/ha, about 1,400 g/ha, about 1,410 g/ha, about 1,420 g/ha, about 1,430 g/ha, about 1,440 g/ha, about 1.450 g/ha, about 1.460 g/ha, about 1,470 g/ha, about 1,480 g/ha, about 1,490 g/ha, about 1,500 g/ha, about 1,510 g/ha, about 1,520 g/ha, about 1,530 g/ha, about 1,540 g/ha, about 1,550 g/ha, about 1,560 g/ha, about 1,570 g/ha, about 1,580 g/ha, about 1,590 g/ha, about 1,600 g/ha, about 1,610 g/ha, about 1,620 g/ha, about 1,630 g/ha, about 1,640 g/ha, about 1,650 g/ha, about 1,660 g/ha, about 1,670 g/ha, about 1,680 g/ha, about 1,690 g/ha, about 1,700 g/ha, about 1,710 g/ha, about 1,720 g/ha, about 1,730 g/ha, about 1,740 g/ha, about 1,750 g/ha, about 1,760 g/ha, about 1,770 g/ha, about 1,780 g/ha, about 1,790 g/ha, about 1,800 g/ha, about 1,810 g/ha, about 1,820 g/ha, about 1,830 g/ha, about 1,840 g/ha, about 1,850 g/ha, about 1,860 g/ha, about 1,870 g/ha, about 1,880 g/ha, about 1,890 g/ha, about 1,900 g/ha, about 1,910 g/ha, about 1,920 g/ha, about 1,930 g/ha, about 1,940 g/ha, about 1,950 g/ha, about 1,960 g/ha, about 1,970 g/ha, about 1,980 g/ha, about 1,990 g/ha, or about 2,000 g/ha.

The term "weeds" relates to any unwanted vegetation and includes, for example, carry-over or "rogue" or "volunteer" crop plants.

In one aspect of the present invention, the crop plants are modified with a recombinant polynucleotide which provides the SDPS and which provides the crop plant with tolerance towards the SDPS-inhibiting herbicide.

Typically, the recombinant polynucleotide will comprise (i) a plant operable promoter operably linked to (ii) the region encoding the SDPS and (iii) a transcription terminator. Typically, the recombinant polynucleotide will further comprise a region which encodes a polypeptide capable of targeting the SDPS to subcellular organelles such as the chloroplast. The recombinant polynucleotide may further comprise, for example, transcriptional enhancers. Furthermore, the region encoding the SDPS can be "codon-optimised" depending on plant host in which expression of the SDPS is desired. The skilled person is well aware of plant operable promoters, transcriptional terminators, chloroplast transit peptides, enhancers etc. that have utility with the context of the present invention.

The SDPS may be a "wild type" enzyme or it may be one which has been modified in order to afford preferential kinetic properties with regard to provision of herbicide tolerant plants.

Examples of suitable SDPS are, but no limited to, those derived from *Arabidopsis thaliana, Triticum aestivum* (Wheat), *Hordeum vulgare* (Barley), *Oryza sativa* (Rice), *Zea mays* (Maize), *Glycine max* (Soybean), *Chlorella fusca* and *Chlamydomonas reinhardtii.*

It should be understood that the modified SDPS can be introduced into the plant by way of a recombinant polynucleotide. FIG. 1 illustrates one example of a plasmid (SEQ ID NO: 19) useful for introducing modified SDPS into the plant. Methods of transformation are described above and known in the art, but briefly. the plasmid in FIG. 1 includes a recombinant polynucleotide comprising (i) a region that encodes an Solanesyl Diphosphate Synthase operably linked to a plant operable promoter.

Regarding vector components in FIG. 1, also with respect to SEQ ID NO: 19, cNPT2-01-04 (Start: 592 End: 1567) encodes Neomycin phosphotransferase; cNPT3-01-01 (Start: 5869 End: 6660) encodes a phosphotransferase conferring resistance to kanamycin; cTETR-01-01 (Start: 10273 End: 10923) is the gene for tet R; SDPS2 F240L (Start: 12305 End: 13564) encodes a modified SDPS; bNLB-01-01 (Start: 2746 End: 2893) shows similarity to T-DNA left border; bNRB-01-03 (Start: 11297 End: 11458) is a T-DNA right border; pNOS-01-01 (Start: 284 End: 590) is a Nos promoter; p35S-07-01 (Start: 11484 End: 11810) is CaMV 35s promoter; p35S-10-01 (Start: 11811 End: 12227) is a CaMV 35s promoter; Replication origin features include oRK2-01-01 (Start: 8317 End: 8934) and oCOLE-03-01 (Start: 9724 End: 10039); tNOS-01-01 (Start: 17 End: 271) is a terminator for Nopaline synthase; tNOS-01-01 (Start: 1786 End: 2040) is a terminator for Nopaline synthase.

Alternatively, the endogenous SDPS can be edited in situ by way of gene editing techniques in order to provide the SDPS that is tolerant to the SDPS-inhibiting herbicide. Such genome editing and/or mutagenesis technologies are well known in the art. As well, introduction may be accomplished by any manner known in the art, including: introgression, transgenic, or sit-directed nucleases (SDN). Particularly, the modification to the nucleic acid sequence is introduced by way of site-directed nuclease (SDN). More particularly, the SDN is selected from: meganuclease. zinc finger, transcription activator-like effector nucleases system (TALEN) or Clustered Regularly Interspaced Short Palindromic Repeats system (CRISPR) system. SDN is also referred to as "genome editing", or genome editing with engineered nucleases (GEEN). This is a type of genetic engineering in which DNA is inserted, deleted or replaced in the genome of an organism using engineered nucleases that create site-specific double-strand breaks (DSBs) at desired locations in the genome. The induced double-strand breaks are repaired through non-homologous end-joining (NHEJ) or homologous recombination (HR), resulting in targeted mutations ('edits'). Particularly SDN may comprises techniques such as: Meganucleases, Zinc finger nucleases (ZFNs), Transcription Activator-Like Effector-based Nucleases (TALEN) (Feng et al. 2013 Cell Res. 23, 1229-1232, Sander & Joung Nat. Biotechnol. 32, 347-355 2014), and the Clustered Regularly Interspaced Short Palindromic Repeats (CRISPR-Cas) system.

Accordingly, the current disclosure is also directed to plasmids useful for editing. The plasmid includes a nucleic acid that encodes a DNA modification enzyme, such as a site-directed nuclease, e.g. a Cas9 nuclease, a Cfp1 nuclease, a dCas9-FokI, a dCpf1-FokI, a chimeric Cas9-cytidine deaminase, a chimeric Cas9-adenine deaminase, a chimeric FEN1-FokI, and a Mega-TALs, a nickase Cas9 (nCas9), a chimeric dCas9 non-FokI nuclease and a dCpf1 non-FokI nuclease. The plasmid also includes at least one guide RNA. Plasmids can also include additional components, for example, they may include a gRNA promoter, e.g. prOsU3-01, which is the Rice U3 promoter for pol III dependent transcription of non-coding RNAs, to regulate expression of the at least one gRNA. Vectors may similarly include additional features such as selectable markers, e.g Phosphomannose Isomerase (PMI) and can be used with mannose selection to recover stably transformed plants. Additional features include and regulatory sequences, e.g. promoters and terminators for regulating expression of selectable markers.

Vectors may further include additional features to assist with transformation, e.g. features to assist with *Agrobacterium*-mediated transformation as described above.

Target sequences may vary and may include a 15-25 nucleotide long sequence including a sequence, e.g. a 3 nucleotide sequence, that encodes an amino acid of Table 1.

Figure 2:
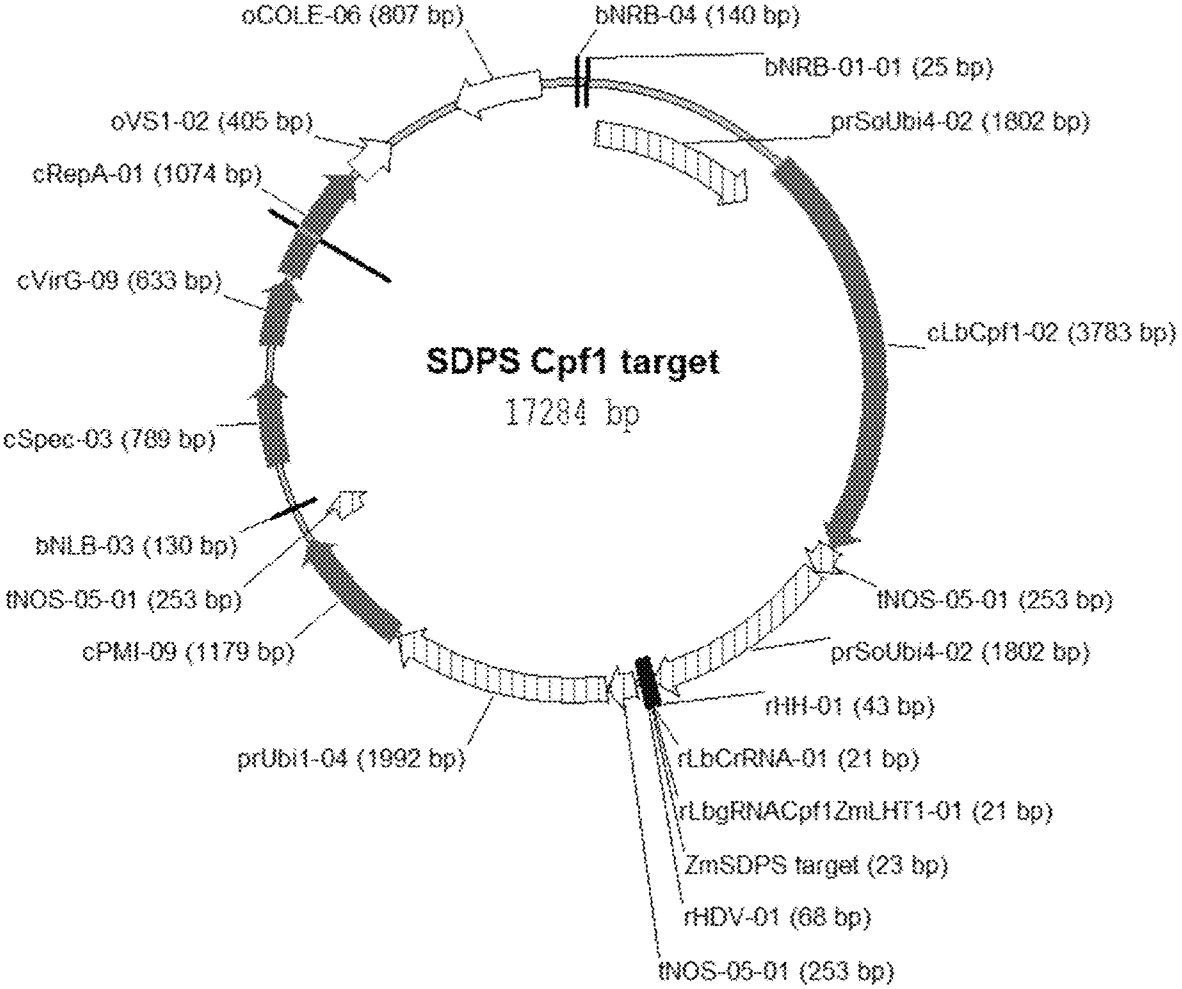
FIG. 2 shows a representation of vector for transformation for gene editing.

FIG. 2 illustrates one example of a plasmid (SEQ ID NO: 42) useful for editing. In this example, the plasmid is a binary CRISPR construct containing the Cpf1 endonuclease targeting a region of the gene in maize. The ubiquitin promoter drives expression of the endonuclease and the gRNA. The vector also contains PMI as the selectable marker.

Regarding vector components illustrated in FIG. 2, with positions relative to SEQ ID NO: 42, cLbCpf1-02 (Start: 2049 End: 5831) is an RNA-guided endonuclease of a class II CRISPR/Cas system and is a rice codon-optimized version from Lachnospiraceae bacterium ND2006; cPMI-09 (Start: 10334 End: 11512) is a synthetic phosphomannose isomerase gene; cSpec-03 (Start: 12240 End: 13028) is a gene encoding the enzyme aminoglycoside 3'adenyltransferase that confers resistance to spectinomycin and streptomycin for maintenance of the vector in *E. coli* and *Agrobacterium*; cVirG-09 (Start: 13328 End: 13960) is a non-functional VirG gene for cloning purposes; cRepA-01 (Start: 13990 End: 15063) encodes a replication protein; bNRB-04 (start: 4 End: 143) is the right border region of T-DNA of *Agrobacterium tumefaciens* nopaline ti-plasmid; bNRB-01-01 (Start: 101 End: 125) is a Right Border Repeat; bNLB-03 (Start: 11831 End: 11960) is the left border region of T-DNA of *Agrobacterium tumefaciens* nopaline ti-plasmid; prSoUbi4-02 (Start: 229 End: 2030) is the constitutive sugarcane ubi4 promoter; prSoUbi4-02 (Start: 6099 End: 7900) is the constitutive sugarcane ubi4 promoter; prUbi1-04 (Start: 8326 End: 10317) is the *Zea Mays* poly ubiquitin 1promoter; oVSI-02 (Start: 15106 End: 15510) is the origin of replication and partitioning region from plasmid pVS1 of *Pseudomonas* and serves as origin of replication in *Agrobacterium tumefaciens* host; oCOLE-06 (Start: 16188 End: 16994) is the ColE1 origin of replication functional in *E. coli*; rHH-01 (Start: 7908 End: 7950) is a conserved sequence motif from Satellite RNAs of certain viruses, including Tobacco ringspot virus, responsible for self-cleavage; rLbCrRNA-01 (Start: 7951 End: 7971) is the scaffold crRNA of LbCpf1, also called direct repeat (DR) of guidc RNA; rLbgRNACpflZmLHT1-01 (Start: 7951 End: 7971) is the CRISPR/Cpf1 guide RNA including direct repeat of Lachnospiraceae bacterium ND2006 LbCrRNA targeting the sequence in the maize genome; rHDV-01 (Start: 7995 End: 8062) is a sequence encoding a self-cleavable ribozyme from hepatitis delta virus (HDV). It should be clear that the example in FIG. 2 is provided by way of illustration only, others skilled in the art will readily be able to design vectors according to the invention.

It should be further understood that the crop plant used in said method may further comprise a further recombinant polynucleotide encoding a further herbicide tolerance enzyme. Examples of further herbicide tolerance enzymes include, for example, herbicide tolerance enzymes selected from the group consisting of, 5-enolpyruvylshikimate-3-phosphate synthase (EPSPS), HST, Glyphosate acetyl transferase (GAT), Cytochrome P450, phosphinothricin acetyltransferase (PAT), Acetolactate synthase (ALS), Protoporphyrinogen oxidase (PPGO), hydroxyphenyl pyruvate dioxygenase (HPPD), Phytoene desaturase (PD), dicamba degrading enzymes (e.g WO 02/068607), and aryloxy herbicide degrading enzymes as taught in WO2007/053482 & WO2005/107437.

The pesticide composition may further comprise one or more additional pesticidal ingredient(s). The additional pesticidal ingredients may include, for example, herbicides, as discussed, however fungicides and/or insecticides may also be included. Preferably, the pesticide composition used in the aforementioned methods may further comprise one or more additional herbicides to which the crop plant is naturally tolerant, or to which it is resistant via expression of one or more additional transgenes as mentioned herein. In a preferred embodiment the one or more additional herbicides are selected from the group consisting of glyphosate (including agrochemically acceptable salts thereof); glufosinate (including agrochemically acceptable salts thereof); chloroacetanilides e.g alachlor, acetochlor, metolachlor, S-metolachlor; photo system II inhibitors e.g triazines such as ametryn, atrazine, cyanazine and terbuthylazine, triazinones such as hexazinone and metribuzin, ureas such as chlorotoluron, diuron, isoproturon, linuron and tebuthiuron; ALS-inhibitors e.g sulfonyl ureas such as amidosulfuron, chlorsulfuron, flupyrsulfuron, halosulfuron, nicosulfuron, primisulfuron, prosulfuron, rimsulfuron, triasulfuron, trifloxysulfuron and tritosulfuron; diphenyl ethers e.g acifluorfen and fomesafen; HPPD-inhibiting herbicides such as mesotrione and bicyclopyrone; dicamba (including agrochemically acceptable salts thereof) and 2,4D (including agrochemically acceptable salts thereof).

The present invention still further provides a recombinant polynucleotide comprising (i) a region which encodes a SDPS operably linked to a plant operable promoter and (ii) at least one additional heterologous polynucleotide, which comprises a region which encodes an additional herbicide tolerance enzyme, operably linked to a plant operable promoter. The additional herbicide tolerance enzyme is, for example, selected from the group consisting of hydroxyphenyl pyruvate dioxygenase (HPPD), 5-enolpyruvylshikimate-3-phosphate synthase (EPSPS), Glyphosate acetyl transferase (GAT), Cytochrome P450, phosphinothricin acetyltransferase (PAT), Acetolactate synthase (ALS), Protoporphyrinogen oxidase (PPGO), Phytoene desaturase (PD) and dicamba degrading enzymes as taught in WO 02/068607.

Preferably the recombinant polynucleotide comprises (i) a region which encodes a SDPS operably linked to a plant operable promoter and (ii) a region which encodes an HPPD operably linked to a plant operable promoter. It is also possible for the recombinant polynucleotide to comprise at least two, three, or more additional regions each encoding a herbicide tolerance enzyme for example as defined previously. Thus, in another preferred embodiment the recombinant polynucleotide comprises (i) a region which encodes a SDPS, (ii) a region which encodes a HPPD enzyme and (iii) a region which encodes a glyphosate tolerance enzyme.

The present invention further provides a vector comprising a recombinant polynucleotide according to the present invention.

The present invention further relates to transformed plants over expressing a SDPS enzyme which exhibit substantial resistance or substantial tolerance to SDPS-inhibiting herbicides when compared with non-transformed like plants.

Thus, the present invention further provides a plant cell which exhibits substantial resistance or substantial tolerance to SDPS-inhibiting herbicides when compared with a non-transformed like plant cell—said plant cell comprising the recombinant polynucleotide of the present invention as herein described. It should be appreciated that the region encoding the SDPS and any region encoding one or more additional herbicide tolerance enzymes may be provided on the same ("linked") or indeed separate transforming recombinant polynucleotide molecules.

The plant cell may further comprise further transgenic traits, for example heterologous polynucleotides providing resistance to insects, fungi and/or nematodes.

The present invention further provides morphologically normal fertile SDPS-inhibitor tolerant plants, plant cells, tissues and seeds which comprise a plant cell according to the present invention.

Plants or plant cells transformed include but are not limited to, field crops, fruits and vegetables such as canola, sunflower, tobacco, sugar beet, cotton, maize, wheat, barley, rice, sorghum, tomato, mango, peach, apple, pear, strawberry, banana, melon, mangelworzel, potato, carrot, lettuce, cabbage, onion, etc. Particularly preferred genetically modified plants are soya spp, sugar cane, pea, field beans, poplar, grape, citrus, alfalfa, rye, oats, turf and forage grasses, flax and oilseed rape, and nut producing plants insofar as they are not already specifically mentioned. In a particularly preferred embodiment of the method the said plant is a dicot, preferably selected from the group consisting of canola, sunflower, tobacco, sugar beet, soybean, cotton, sorghum, tomato, mango, peach, apple, pear, strawberry, banana, melon, potato, carrot, lettuce, cabbage, onion, and is particularly preferably soybean. In further preferred embodiments the said plant is maize or rice. Preferably the plant of the invention is soybean, rice or maize. The invention also includes the progeny of the plant of the preceding sentence, and the seeds or other propagating material of such plants and progeny.

The present invention still further provides a method of providing a transgenic plant which is tolerant to SDPS-inhibiting herbicides which comprises transformation of plant material with a recombinant polynucleotide(s) which comprises a region which encodes an SDPS enzyme, selection of the transformed plant material using an SDPS-inhibiting herbicide, and regeneration of that material into a morphological normal fertile plant.

The present invention further relates to methods for the use of polynucleotide which comprises a region that encodes an SDPS as a selectable marker in plant transformation and to the use of a polynucleotide comprising a region which encodes SDPS in the production of plants which are tolerant to herbicides which act wholly or in part by inhibiting SDPS.

The present invention still further relates to the use of SDPS inhibitors as selection agents in plant transformation and to the use of a recombinant SDPS in an in vitro screening method for identifying SDPS-inhibiting herbicides.

The present disclosure is also directed to various methods for identifying a Solanesyl Diphosphate Synthase-inhibiting herbicide. In typical embodiments, methods comprise expressing an SDPS in a plant; and exposing the plant to a herbicide, wherein reduced damage in the plant relative to a control plant that is not expressing the SDPS indicates that the compound is a Solanesyl Diphosphate Synthase-inhibiting herbicide. The SDPS may be selected from (a) an SDPS of SEQ ID NOS: 1-18, 45-349, and 663-665; or (b) a "modified" SDPS having an amino acid sequence that is at least 80% identical to a sequence set forth in SEQ ID NOS: 1-18, 45-349, and 663-665; or (c) a "modified" SDPS having an amino acid sequence that is at least 90% identical to a sequence set forth in SEQ ID NOS: 1-18, 45-349, and 663-665; or (d) a "modified" SDPS having an amino acid sequence that is at least 95% identical to a sequence set forth in SEQ ID NOS: 1-18 and 45-349; or (e) an SDPS having a motif selected from SEQ ID NOS: 655-662, or (f) an SDPS having at least one mutation at a position corresponding to one of the following amino acid positions of SEQ ID NO: 5: F240L, F227L, F229L, F247L, L120A, I120R, I120W, L123A, L123C, L123D, L123N, L123S, L123W, E127A, E127G, E127K, E127Y, N128L, N128P, V130D, V130K, L131A, L131E, L131M, L131P, A134V, F139D, F139K, F139N, F139R, F139T, P148I, P148L, P148M, P148T, P148V, V151E, V151F, V151I, V151M, V151N, L174F, L174T, A175I, A175P, A175S, E176A, E176D, E176H, E176K, E176N, E176P, E176Y, I177A, I177C, I177F, I177L, I177M, I177S, I177T, I177Y, I178G, I178Q, I178W, E179I, M180I, M180Q, M180S, M180Y, M180W, I181M, I181N, A184G, A184S, A184T, T183C, T183Q, S185A, S185T, S185O, I187E, I187F, I187T, I187V, H188F, H188I, H188L, H188M, H188V, V191A, V191T, I204A, I204F, I204G, I204H, I204K, I204Q, I204R, I204S, I204T, Y208A, Y208D, Y208E, Y208H, Y208I, Y208K, Y208L, Y208M, Y208N, Y208Q, Y208R, Y208S, Y208T, Y208V, G209N, T210Y, R211D, R211E, R211N, R211T, R211V, L215I, L215M, A216T, F219A, M220I, M220C, F221W, A222G, A222M, A222S, Q223A, Q223E, Q223F, Q223G, Q223H, Q223I, Q223K, Q223L, Q223M, Q223R, Q223Y, S224F, S224I, S224M, S224N, S224Q, S224T, S224V, S225C, S225F, S225H, S225I, S225K, S225M, S225N, S225Q, S225T, S225V, S225Y, W226A, W226C, W226E, W226I, W226L, W226Q, W226R, W226T, W226V, F227D, F227L, F227M, F227R, F227V, F227W, L228C, L228I, L228M, L228T, L228V, A229H, A229I, A229L, A229M, A229N, A229T, N230E, N230R, E235G, K238G, K238N, K238S, L239A, L239R, I240A, I240C, I240W, S241A, S241H, S241N, S241T, V243A, V243G, V243N, V243Q, V243S, I244A, I244F, I244G, I244H, I244K, I244L, I244M, I244N, I244P, I244Q, I244S, I244V, I244Y, K245F, K245H, K245M, K245N, K245W, D246E, D246M, D246N, D246Q, D246S, D246T, D246Y, F247E, F247L, F247M, F247N, F247V, A248P, S249A, S249E, S249F, S249G, S249K, S249L, S249N, S249Q, S249T, S249V, S249Y, G250A, I252L, I252M, I252V, K253L, A255T, A255W, S256N, T257E, T257G, T257H, T257M, T257Q, T257W, Y274D, Y274G, Y274L, Y274M, Y274Q, T276S, L279F, I280W, I280F, A282G, A282H, A282K, A282N, A282R, S283C, S283F, S283I, S283M, S283T, S283W, R306F, R306H, R306L, R306N, L310G, G309A, G309F, G309M, G309S, L310D, L310E, L310F, L310H, L310N, L310Q, L310W, L310Y, F312C, F312I, F312L, F312M, F312V, Q313A, Q313C, Q313D, Q313S, and Q313T. In many examples, SDPS variants may include 2, 3, 4, 5, 6, or 7 of the above-mentioned mutations. Observed damage will typically include bleaching. Rates of exposure may vary and may include exposing is in the range of 2.5 ppm to 20 ppm.

The present disclosure is also directed to various methods of identifying Solanesyl Diphosphate Synthase variants with increased tolerance to a reference Solanesyl Diphosphate Synthase-inhibiting herbicide (reference herbicide). The reference herbicide may be, for example, a commercial herbicide having an unknown mode of action or a novel herbicide. Methods typically comprise obtaining a first plant expressing a first SDPS variant and a second plant expressing a second SDPS variant that contains at least one different amino acid than the first variant; and exposing the first plant and the second plant to the reference herbicide, wherein reduced damage in one of the plants relative to the other plant indicates the presence of a variant having increased tolerance to the reference herbicide. Any amino acid may be changed in the variants, and in many embodiments, variants will differ by two, three, four, five or more amino acids. Exemplary amino acids for producing variants include those in Table 1. The SDPS may include, (a) an SDPS of SEQ ID NOS: 1-18, 45-349, and 663-665; or (b) a "modified" SDPS having an amino acid sequence that is at least 80% identical to a sequence set forth in SEQ ID NOS: 1-18, 45-349, and 663-665; or (c) a "modified" SDPS having an amino acid sequence that is at least 90% identical to a sequence set forth in SEQ ID NOS: 1-18, 45-349, and 663-665; or (d) a "modified" SDPS having an amino acid sequence that is at least 95% identical to a sequence set forth in SEQ ID NOS: 1-18, 45-349, and 663-665; or (c) an SDPS having a motif chosen from SEQ ID NOS: 655-662; or (f) or an SDPS having at least one mutation at a position corresponding to one of the amino acid positions of SEQ ID NO: 5 exemplified above. Exposure rates may vary, e.g. in the range of 2.5 ppm to 20 ppm.

Example 1. Expression of SDPS Enzymes

DNA sequences, optimized for *E. coli* codon usage encoding N-terminally his-tagged SDPS genes (Seq IDs 13-18) are synthesized by Genewiz (South Plainfield, USA) to include 5' NdeI and 3' NotI restriction sites. These are cloned into the *E coli* expression plasmid pET24a (Novagen) via the NdeI and NotI restriction sites and the resultant plasmid transformed into *E. coli* BL21 (DE3) and thereafter maintained with 50 μg/ml kanamycin. Transformation of *E. coli* BL21 (DE3) competent cells from Agilent is carried out according to the manufacturer's instructions. In brief, 100 ul aliquots of competent cells are thawed, pre-mixed on ice with 1.7 ul of β-mercaptoethanol and then incubated, swirling gently, for 30 min on ice with 1-50 ng of DNA. Each transformation reaction is briefly (45 s) warmed to 42° C. before returning to ice and then mixed with 0.9 ml of SOC medium pre-warmed to 42° C. The cell suspension is then incubated at 37° C. for 1 hour, shaking at 250 rpm before plating out 5 and 50 ul aliquots onto LB agar plates containing 50 μg/ml kanamycin. Transformed colonies are picked after an overnight grow. After pre-growth in an initial seed culture, transformed cells are transferred to Formedium Autoinduction Media (which has a Terrific broth base and includes trace elements (Cat no: AIMTB0210)) and the culture grown for 3 hours at 37° C. in a 2.5 L flask, 200 rpm before overnight growth at 20° C., 200 rpm. Cells are harvested at 6,000 rpm. 20 mins, 4° C. Following biomass harvesting, approximately 20 g wet weight of cell paste is resuspended in 100 ml of lysis buffer which is PBS (Phosphate buffered saline) pH 7.4, 10% glycerol, 20 mM Imidazole. Cells are stirred for approximately 30 mins to resuspend and then lysed using a constant systems cell disruptor at a pressure of 20000 psi. The cell lysate is clarified by centrifugation in a Beckman JA 25.5 rotor spun for 30 mins at 50,000×g at 4° C. All subsequent purification steps are carried out at 4° C. Clarified lysate is then applied to a 5 ml HisTrap FF column equilibrated in PBS at pH 7.4, 10% glycerol, 20 mM Imidazole. The column is washed with 20 column volumes of this buffer and bound protein is then eluted in 3.5 column volumes of PBS at pH 7.4, 10% glycerol, 500 mM Imidazole. The eluted protein is then further purified and the buffer exchanged down a GE 26/60 S200 SEC column into 150 mM MOPS at pH8.0, 50 mM NaCl, 10% glycerol. Elution fractions containing the protein of interest are pooled and the sample beaded in liquid nitrogen before storage at −80° C. Protein concentration is determined using the Nanodrop ME52070. The protein obtained typically runs as a single major band corresponding to the expected molecular weight of ~44 kDa (e.g. for N-terminally his-tagged SEQ ID NO: 13) according to SDS PAGE stained with Coomassie blue and is typically judged to be >~90% pure based on gel densitometry.

Example 2. Assay of Solanesyl Diphosphate Synthase Activity

Polyprenyl transferase activity is assayed via measurement of phosphate production from incorporation of isopentenyl pyrophosphate (IPP) into geranylgeranyl pyrophosphate (GGPP). which releases pyrophosphate. The assay is coupled to an inorganic pyrophosphatase (IPPase) to release inorganic phosphate that is quantitated using malachite green reagent. Assays are run in 96-well microtiter plates. Herbicides are dissolved as stock solutions at sufficiently high concentrations in dimethylsulfoxide (DMSO). 2 µl of appropriate concentrations of diluted herbicide arc transferred to 96-well transparent microtiter plates. Enzyme, typically at a stock concentration of ~10 mg/ml is diluted to 128 nM in 100 mM Tricine buffer at pH 8.0 containing 641 mM IPP. 12.8 mM $MgC_2$, 6.41 mg/ml bovine serum albumin (BSA), 0.26% Tween 20 and 1.28 units/ml IPPase from *Escherichia coli.* 78 µl aliquots of this mixture are added to each well of the plate containing the herbicide. The plate is incubated at 25° C. for 60 min before the assay is initiated with 20 µl of 250 mM GGPP in 100 mM Tricine pH 8.0. Assays at 25° C. arc typically incubated for 10-60 min, before stopping with 200 µl malachite green reagent. To prepare malachite green reagent, 600 ml of 1 mM malachite green oxalate was mixed with 200 ml of 33 mM ammonium molybdate in 3.92 M HCl. The colour change is left to develop for 15 min before reading the absorbance at 630 nm in a Tecan M200 plate reader. Phosphate standard curves are run alongside each set of assays. Reagent blank controls (MAX) are run with DMSO in place of test herbicide and full inhibition controls (MIN) assays with a sufficiently high concentration of test herbicide are run to determine the percentage inhibition in each well using the expression, percentage inhibition=100×(1−(X−MIN)/(MAX−MIN)), where X is the absorbance at 630 nm and MIN and MAX the average absorbance of the controls. The percentage inhibition values are fitted to a four parameter logistic regression to determine the half maximal inhibitory concentration ($IC_{50}$).

In an alternative method for assaying polyprenyl transferase activity, phosphate is quantitated using the Thermo Fisher EnzChek assay kit according to the manufacturer's instructions. This method couples inorganic phosphate production to the enzymatic conversion of 2-amino-6-mercapto-7-methylpurine riboside (MESG) to ribose 1-phosphate and 2-amino-6-mercapto-7-methylpurine by purine nucleoside phosphorylase (PNP). Herbicides are dissolved as stock solutions at sufficiently high concentrations in DMSO. 4 µl of appropriate concentrations of diluted herbicide arc transferred to 96-well transparent microtiter plates. Enzyme, typically at a stock concentration of ~10 mg/ml is diluted to 227 nM in 100 mM Tricine buffer at pH 8.0 containing 570 mM IPP, 11.4 mM $MgCl_2$, 5.7 mg/ml BSA, 0.23% Tween 20, 1.14 units/ml IPPase from *Escherichia coli,* 1.14 units/mil PNP. 5% reaction buffer supplied by the manufacturer and 0.23 mM MESG. 176 pl aliquots of this mixture are added to each well of the plate containing the herbicide. The plate is incubated at 25° C. for 60 min before the assay is initiated with 20 µl of 500 mM GGPP in 100 mM Tricine pH 8.0. Assays at 25° C. are measured by reading the absorbance at 360 nm typically for 10-60 min in a Tecan M200 plate reader. Comparative rates are calculated from the rate of change in absorbance from the linear region of assay by comparison with a phosphate standard curve. Reagent blank controls (MAX) are run with DMSO in place of test herbicide and full inhibition controls (MIN) assays with a sufficiently high concentration of test herbicide are run to determine the percentage inhibition in each well using the expression, percentage inhibition=100×(1−(X−MIN)/(MAX−MIN)), where X is the rate of change in absorbance at 360 nm and MIN and MAX the average rates of the controls. The percentage inhibition values are fitted to a four parameter logistic regression to determine the half maximal inhibitory concentration ($IC_{50}$).

Example 3. Identification of Herbicide Tolerant Variants of SDPS Enzymes

SDPS variants with increased herbicide tolerance to Herbicide Compound Exs 1 and 2 were identified using the assays described in Example 2. SDPS sequences such as SEQ ID NO.16 were codon optimised for *E coli* expression and single site saturation libraries were created at desired amino acid positions (Twist Bioscience, USA) which results in a pool of all possible amino acid substitutions at the selected amino acid position. Table 1 shows the selected amino acid positions (numbering based on SEQ ID NO.5) which were varied, assayed and sequenced. Table 1A shows amino acid motifs for exemplary SDPS motifs of the invention.

TABLE 1

| | | | | | | | | | |
|---|---|---|---|---|---|---|---|---|---|
| L120 | I138 | E179 | D189 | A213 | Q223 | K238 | A248 | L258 | I280 |
| L123 | F139 | M180 | D190 | V214 | S224 | L239 | S249 | K271 | A281 |
| V124 | R147 | I181 | V191 | L215 | S225 | I240 | G250 | S272 | A282 |
| G125 | P148 | H182 | I192 | A216 | W226 | S241 | E251 | Y273 | S283 |
| A126 | V151 | T183 | I204 | G217 | F227 | Q242 | I252 | Y274 | Y302 |
| E127 | L174 | A184 | Y208 | D218 | L228 | V243 | K253 | K275 | R306 |
| N128 | A175 | S185 | G209 | F219 | A229 | I244 | Q254 | T276 | G309 |
| V130 | E176 | L186 | T210 | M220 | N230 | K245 | A255 | A277 | L310 |
| L131 | I177 | I187 | R211 | F221 | V236 | D246 | S256 | S278 | F312 |
| A134 | I178 | H188 | V212 | A222 | I237 | F247 | T257 | L279 | Q313 |

TABLE 1A

| | | |
|---|---|---|
| SEQ ID NO: 655 | N, X1, N, X2, X3, X4, X5, X6, G, X7, X8, X9, P, X10, X11, | X1 = N or K or H or D, X2 = L or A or R or W, X3 = K or Q or R or L, X4 = N or S, X5 = L or I or A or C or D or N or S or W, X6 = I or V, X7 = A or E or S, X8 = E or R or A or G or K or Y, X9 = N or S |

TABLE 1A-continued

| | | |
|---|---|---|
| | X12, X13, A, X14, X15, Q, I, X16, X17, A, G, G, K | or P or L, X10 = V or M or D or K, X11 = L or A or E or M or P, X12 = M or V or I, X13 = A or S, X14 = A or V, X15 = E or D, X16 = F or D or K or N or R or T, X17 = G or S |
| SEQ ID NO: 656 | K, X1, X2, R, X3, X4, X5, X6, F, L | X1 = K or R, X2 = L or V or M, X3 = P or I or L or M or T or V, X4 = A or M or G, X5 = L or I, X6 = V or E or F or I or M or N |
| SEQ ID NO: 657 | H, X1, R, X2, X3, X4, X5, X6, X7, X8, H, X9, X10, X11, L, X12, X13, D, D, X14, X15, D | X1 = K or Q or R, X2 = L or F or T, X3 = A or G or I or P or S, X4 = E or A or D or H or K or N or P or Y, X5 = I or A or C or F or L or M or S or T or Y, X6 = I or G or Q or W, X7 = E or I, X8 = M or I or Q or S or Y or W, X8 = M or I or Q or S or Y or W, X9 = I or M or N, X10 = T or C or Q, X11 = A or G or S, or T, X12 = S or T or G, X13 = I or E or F or T or V, X14 = H or I or F or M or V or L, X15 = V or A or T |
| SEQ ID NO: 658 | G, X1, X2, T, X3, X4, X5, X6, X7, X8, X9, X10, X11, A, V, X12, X13, G, D, X14 | X1 = K or R, X2 = D or E or K or Q, X3 = I or V or A or F or G or H or K or Q or R or S or T, X4 = H or N, X5 = Q or T or E, X6 = L or M, X7 = Y or F or A or D or E or H or I or K or L or M or N or Q or R or S or T or V, X8 = G or N, X9 = T or Y, X10 = R or D or E or N or T or V, X11 = I or V, X12 = L or I or M, X13 = A or T, X14 = F or A |
| SEQ ID NO: 659 | X1, X2, X3, X4, X5, X6, X7, X8, X9, X10, X11, L, E | X1 = M or I or L or C, X2 = F or W, X3 = A or G or M or S, X4 = Q or A or E or F or G or H or I or K or L or M or R or Y, X5 = S or A or F or I or M or N or Q or T or V, X6 = S or C or F or H or I or K or M or N or Q or T or V or Y, X7 = W or A or C or E or I or L or Q or R or T or V, X8 = F or Y or L or D, or M or R or V or W, X9 = L or I or C or M or T or V, X10 = A or H or I or L or N or M or T, X11 = N or E or R |
| SEQ ID NO: 660 | N, X1, X2, V, I, X3, X4, X5, X6, X7, X8, X9, X10, X11, X12, X13, X14, X15, E, X16, X17, Q, X18, X19, X20 | X1 = I or L, X2 = E or Q or G, X3 = K or G or N or S, X4 = L or A or R, X5 = I or A or C or W, X6 = S or A or H or N or T, X7 = Q or K, X8 = V or A or G or N or Q or S, X9 = I or A or F or G or H or K or L or M or N or P or Q or S or V or Y, X10 = K or A or F or H or M or N or W, X11 = D or E or M or N or Q or S or T or Y, X12 = F or E or L or M or N or V, X13 = A or P, X14 = S or N or A or E or F or G or K or L or N or Q or T or V or Y, X15 = G or A, X16 = I or L or M or V, X17 = K or S or L, X18 = A or Q or T or W, X19 = S or N, X20 = S or T or N or E or G or H or M or Q or W |
| SEQ ID NO: 661 | S, X1, X2, K, X3, A, S, X4, X5, A, X6, X7, X8 | X1 = F or Y, X2 = Y or D or G or L or M or Q, X3 = T or S, X4 = L or F, X5 = L or V or I or F or W, X6 = A or S or G or H or K or N or R, X7 = S or C or F or I or M or T or W, X8 = T or C |
| SEQ ID NO: 662 | G, X1, X2, L, X3, X4, X5, X6, X7, V, V | X1 = R or K or F or H or L or N, X2 = N or H, X3 = G or A or F or M or S, X4 = L or D or E or F or G or H or N or Q or W or Y, X5 = A or S, X6 = F or C or I or L or M or V, X7 = Q or A or C or D or S or T |

Table 2 shows the SDPS variants which demonstrated increased tolerance over the parental sequence, SEQ ID NO: 16, to herbicides X and Y in the assay described in example 2.

| SEQ ID | SDPS Variant | 7 uM Herbicide X (922) | 7 uM Herbicide Y (665) |
|---|---|---|---|
| SEQ ID NO: 45 | L120A | + | |
| SEQ ID NO: 46 | L120R | ++ | |
| SEQ ID NO: 47 | L120W | + | |
| SEQ ID NO: 48 | L123A | ++ | |
| SEQ ID NO: 49 | L123C | + | |
| SEQ ID NO: 50 | L123D | ++ | |
| SEQ ID NO: 51 | L123N | ++ | |
| SEQ ID NO: 52 | L123S | + | |
| SEQ ID NO: 53 | L123W | ++ | |
| SEQ ID NO: 54 | E127A | + | + |
| SEQ ID NO: 55 | E127G | + | + |
| SEQ ID NO: 56 | E127K | + | + |
| SEQ ID NO: 57 | E127Y | + | + |
| SEQ ID NO: 58 | N128L | + | |
| SEQ ID NO: 59 | N128P | + | |
| SEQ ID NO: 60 | V130D | | + |
| SEQ ID NO: 61 | V130K | | + |
| SEQ ID NO: 62 | L131A | | ++ |
| SEQ ID NO: 63 | L131E | + | |
| SEQ ID NO: 64 | L131M | | + |
| SEQ ID NO: 65 | L131P | + | |
| SEQ ID NO: 66 | A134V | + | |
| SEQ ID NO: 67 | F139D | + | |
| SEQ ID NO: 68 | F139K | + | |
| SEQ ID NO: 69 | F139N | + | |

-continued

| SEQ ID | SDPS Variant | 7 uM Herbicide X (922) | 7 uM Herbicide Y (665) |
|---|---|---|---|
| SEQ ID NO: 70 | F139R | + | |
| SEQ ID NO: 71 | F139T | + | |
| SEQ ID NO: 72 | P148I | ++ | |
| SEQ ID NO: 73 | P148L | ++ | |
| SEQ ID NO: 74 | P148M | ++ | |
| SEQ ID NO: 75 | P148T | + | |
| SEQ ID NO: 76 | P148V | ++ | |
| SEQ ID NO: 77 | V151E | | + |
| SEQ ID NO: 78 | V151F | + | |
| SEQ ID NO: 79 | V151I | + | |
| SEQ ID NO: 80 | V151M | + | |
| SEQ ID NO: 81 | V151N | + | |
| SEQ ID NO: 82 | L174F | + | |
| SEQ ID NO: 83 | L174T | | + |
| SEQ ID NO: 84 | A175I | ++ | |
| SEQ ID NO: 85 | A175P | + | |
| SEQ ID NO: 86 | A175S | + | |
| SEQ ID NO: 87 | E176A | + | + |
| SEQ ID NO: 88 | E176D | + | |
| SEQ ID NO: 89 | E176H | + | |
| SEQ ID NO: 90 | E176K | + | |
| SEQ ID NO: 91 | E176N | + | |
| SEQ ID NO: 92 | E176P | + | + |
| SEQ ID NO: 93 | E176Y | + | |
| SEQ ID NO: 94 | I177A | ++ | |
| SEQ ID NO: 95 | I177C | ++ | |
| SEQ ID NO: 96 | I177F | + | + |
| SEQ ID NO: 97 | I177L | | ++ |
| SEQ ID NO: 98 | I177M | | + |
| SEQ ID NO: 99 | I177S | ++ | |

-continued

| SEQ ID | SDPS Variant | 7 uM Herbicide X (922) | 7 uM Herbicide Y (665) |
|---|---|---|---|
| SEQ ID NO: 100 | I177T | + | |
| SEQ ID NO: 101 | I177Y | + | + |
| SEQ ID NO: 102 | I178G | | + |
| SEQ ID NO: 103 | I178Q | | ++ |
| SEQ ID NO: 104 | I178W | ++ | |
| SEQ ID NO: 105 | E179I | + | |
| SEQ ID NO: 106 | M180I | + | |
| SEQ ID NO: 107 | M180Q | + | |
| SEQ ID NO: 108 | M180S | + | |
| SEQ ID NO: 109 | M180W | + | |
| SEQ ID NO: 110 | M180Y | + | |
| SEQ ID NO: 111 | I181M | + | + |
| SEQ ID NO: 112 | I181N | + | + |
| SEQ ID NO: 113 | T183C | ++ | |
| SEQ ID NO: 114 | T183Q | ++ | |
| SEQ ID NO: 115 | A184G | + | + |
| SEQ ID NO: 116 | A184S | + | + |
| SEQ ID NO: 117 | A184T | + | + |
| SEQ ID NO: 118 | S185A | ++ | |
| SEQ ID NO: 119 | S185G | | + |
| SEQ ID NO: 120 | S185T | ++ | |
| SEQ ID NO: 121 | I187E | ++ | |
| SEQ ID NO: 122 | I187F | + | + |
| SEQ ID NO: 123 | I187T | + | |
| SEQ ID NO: 124 | I187V | + | |
| SEQ ID NO: 125 | H188F | + | + |
| SEQ ID NO: 126 | H188I | + | + |
| SEQ ID NO: 127 | H188L | + | + |
| SEQ ID NO: 128 | H188M | + | + |
| SEQ ID NO: 129 | H188V | + | + |
| SEQ ID NO: 130 | V191A | ++ | |
| SEQ ID NO: 131 | V191T | ++ | |
| SEQ ID NO: 132 | I204A | + | |
| SEQ ID NO: 133 | I204F | + | |
| SEQ ID NO: 134 | I204G | + | |
| SEQ ID NO: 135 | I204H | + | |
| SEQ ID NO: 136 | I204K | + | |
| SEQ ID NO: 137 | I204Q | + | |
| SEQ ID NO: 138 | I204R | + | |
| SEQ ID NO: 139 | I204S | + | |
| SEQ ID NO: 140 | I204T | + | |
| SEQ ID NO: 141 | Y208A | + | |
| SEQ ID NO: 142 | Y208D | + | |
| SEQ ID NO: 143 | Y208E | + | |
| SEQ ID NO: 144 | Y208H | + | |
| SEQ ID NO: 145 | Y208I | ++ | |
| SEQ ID NO: 146 | Y208K | + | |
| SEQ ID NO: 147 | Y208L | + | |
| SEQ ID NO: 148 | Y208M | + | |
| SEQ ID NO: 149 | Y208N | + | |
| SEQ ID NO: 150 | Y208Q | + | |
| SEQ ID NO: 151 | Y208R | + | |
| SEQ ID NO: 152 | Y208S | + | |
| SEQ ID NO: 153 | Y208T | + | |
| SEQ ID NO: 154 | Y208V | + | |
| SEQ ID NO: 155 | G209N | + | |
| SEQ ID NO: 156 | T210Y | | + |
| SEQ ID NO: 157 | R211D | | ++ |
| SEQ ID NO: 158 | R211E | | ++ |
| SEQ ID NO: 159 | R211N | | ++ |
| SEQ ID NO: 160 | R211T | | + |
| SEQ ID NO: 161 | R211V | | ++ |
| SEQ ID NO: 162 | L215I | | ++ |
| SEQ ID NO: 163 | L215M | + | |
| SEQ ID NO: 164 | A216T | + | |
| SEQ ID NO: 165 | F219A | + | |
| SEQ ID NO: 166 | M220I | + | |
| SEQ ID NO: 167 | M220C | | + |
| SEQ ID NO: 168 | F221W | | ++ |
| SEQ ID NO: 169 | A222G | | ++ |
| SEQ ID NO: 170 | A222M | ++ | |
| SEQ ID NO: 171 | A222S | | ++ |
| SEQ ID NO: 172 | Q223A | + | + |
| SEQ ID NO: 173 | Q223E | + | + |
| SEQ ID NO: 174 | Q223F | + | + |
| SEQ ID NO: 175 | Q223G | + | + |

-continued

| SEQ ID | SDPS Variant | 7 uM Herbicide X (922) | 7 uM Herbicide Y (665) |
|---|---|---|---|
| SEQ ID NO: 176 | Q223H | + | + |
| SEQ ID NO: 177 | Q223I | + | |
| SEQ ID NO: 178 | Q223K | + | |
| SEQ ID NO: 179 | Q223L | + | + |
| SEQ ID NO: 180 | Q223M | + | + |
| SEQ ID NO: 181 | Q223R | + | + |
| SEQ ID NO: 182 | Q223Y | + | + |
| SEQ ID NO: 183 | S224F | + | + |
| SEQ ID NO: 184 | S224I | + | + |
| SEQ ID NO: 185 | S224M | + | |
| SEQ ID NO: 186 | S224N | + | + |
| SEQ ID NO: 187 | S224Q | + | |
| SEQ ID NO: 188 | S224T | + | + |
| SEQ ID NO: 189 | S224V | | ++ |
| SEQ ID NO: 190 | S225C | | ++ |
| SEQ ID NO: 191 | S225F | + | + |
| SEQ ID NO: 192 | S225H | + | |
| SEQ ID NO: 193 | S225I | + | |
| SEQ ID NO: 194 | S225K | + | + |
| SEQ ID NO: 195 | S225M | | ++ |
| SEQ ID NO: 196 | S225N | + | + |
| SEQ ID NO: 197 | S225Q | ++ | |
| SEQ ID NO: 198 | S225T | | + |
| SEQ ID NO: 199 | S225V | | ++ |
| SEQ ID NO: 200 | S225Y | + | |
| SEQ ID NO: 201 | W226A | | ++ |
| SEQ ID NO: 202 | W226C | + | |
| SEQ ID NO: 203 | W226E | + | + |
| SEQ ID NO: 204 | W226I | | ++ |
| SEQ ID NO: 205 | W226L | + | |
| SEQ ID NO: 206 | W226Q | | ++ |
| SEQ ID NO: 207 | W226R | + | + |
| SEQ ID NO: 208 | W226T | + | + |
| SEQ ID NO: 209 | W226V | | ++ |
| SEQ ID NO: 210 | F227D | + | |
| SEQ ID NO: 211 | F227L | + | |
| SEQ ID NO: 212 | F227M | + | |
| SEQ ID NO: 213 | F227R | | + |
| SEQ ID NO: 214 | F227V | + | |
| SEQ ID NO: 215 | F227W | + | |
| SEQ ID NO: 216 | L228C | + | + |
| SEQ ID NO: 217 | L228I | + | + |
| SEQ ID NO: 218 | L228M | | ++ |
| SEQ ID NO: 219 | L228T | | ++ |
| SEQ ID NO: 220 | L228V | + | + |
| SEQ ID NO: 221 | A229H | + | + |
| SEQ ID NO: 222 | A229I | | + |
| SEQ ID NO: 223 | A229L | ++ | |
| SEQ ID NO: 224 | A229M | + | + |
| SEQ ID NO: 225 | A229N | + | + |
| SEQ ID NO: 226 | A229T | + | |
| SEQ ID NO: 227 | N230E | + | |
| SEQ ID NO: 228 | N230R | | + |
| SEQ ID NO: 229 | E235G | | + |
| SEQ ID NO: 230 | K238G | + | |
| SEQ ID NO: 231 | K238N | + | + |
| SEQ ID NO: 232 | K238S | + | |
| SEQ ID NO: 233 | L239A | | + |
| SEQ ID NO: 234 | L239R | + | |
| SEQ ID NO: 235 | I240A | + | |
| SEQ ID NO: 236 | I240C | ++ | |
| SEQ ID NO: 237 | I240W | ++ | |
| SEQ ID NO: 238 | S241A | | + |
| SEQ ID NO: 239 | S241H | | + |
| SEQ ID NO: 240 | S241N | | + |
| SEQ ID NO: 241 | S241T | | ++ |
| SEQ ID NO: 242 | V243A | + | + |
| SEQ ID NO: 243 | V243G | + | + |
| SEQ ID NO: 244 | V243N | ++ | |
| SEQ ID NO: 245 | V243Q | ++ | |
| SEQ ID NO: 246 | V243S | + | + |
| SEQ ID NO: 247 | I244A | + | + |
| SEQ ID NO: 248 | I244F | + | + |
| SEQ ID NO: 249 | I244G | + | + |
| SEQ ID NO: 250 | I244H | + | + |
| SEQ ID NO: 251 | I244K | + | + |

-continued

| SEQ ID | SDPS Variant | 7 uM Herbicide X (922) | 7 uM Herbicide Y (665) |
|---|---|---|---|
| SEQ ID NO: 252 | I244L | + | + |
| SEQ ID NO: 253 | I244M | + | + |
| SEQ ID NO: 254 | I244N | + | + |
| SEQ ID NO: 255 | I244P | + | + |
| SEQ ID NO: 256 | I244Q | + | + |
| SEQ ID NO: 257 | I244S | + | + |
| SEQ ID NO: 258 | I244V | ++ | |
| SEQ ID NO: 259 | I244Y | + | + |
| SEQ ID NO: 260 | K245F | + | + |
| SEQ ID NO: 261 | K245H | + | + |
| SEQ ID NO: 262 | K245M | + | |
| SEQ ID NO: 263 | K245N | ++ | |
| SEQ ID NO: 264 | K245W | | + |
| SEQ ID NO: 265 | D246E | + | |
| SEQ ID NO: 266 | D246M | + | |
| SEQ ID NO: 267 | D246N | + | |
| SEQ ID NO: 268 | D246Q | + | |
| SEQ ID NO: 269 | D246S | + | |
| SEQ ID NO: 270 | D246T | ++ | |
| SEQ ID NO: 271 | D246Y | + | + |
| SEQ ID NO: 272 | F247E | + | |
| SEQ ID NO: 273 | F247L | + | + |
| SEQ ID NO: 274 | F247M | + | + |
| SEQ ID NO: 275 | F247N | ++ | |
| SEQ ID NO: 276 | F247V | + | + |
| SEQ ID NO: 277 | A248P | + | + |
| SEQ ID NO: 278 | S249A | + | |
| SEQ ID NO: 279 | S249E | | ++ |
| SEQ ID NO: 280 | S249F | ++ | |
| SEQ ID NO: 281 | S249G | ++ | |
| SEQ ID NO: 282 | S249K | + | |
| SEQ ID NO: 283 | S249L | + | |
| SEQ ID NO: 284 | S249N | | ++ |
| SEQ ID NO: 285 | S249Q | | ++ |
| SEQ ID NO: 286 | S249T | | ++ |
| SEQ ID NO: 287 | S249V | | ++ |
| SEQ ID NO: 288 | S249Y | + | |
| SEQ ID NO: 289 | G250A | | ++ |
| SEQ ID NO: 290 | I252L | + | |
| SEQ ID NO: 291 | I252M | + | + |
| SEQ ID NO: 292 | I252V | | ++ |
| SEQ ID NO: 293 | K253L | + | + |
| SEQ ID NO: 294 | A255T | + | |
| SEQ ID NO: 295 | A255W | | ++ |
| SEQ ID NO: 296 | S256N | | ++ |
| SEQ ID NO: 297 | T257E | | ++ |
| SEQ ID NO: 298 | T257G | | ++ |
| SEQ ID NO: 299 | T257H | ++ | |
| SEQ ID NO: 300 | T257M | ++ | |
| SEQ ID NO: 301 | T257Q | ++ | |
| SEQ ID NO: 302 | T257W | | ++ |
| SEQ ID NO: 303 | Y274D | + | |
| SEQ ID NO: 304 | Y274G | + | |
| SEQ ID NO: 305 | Y274L | + | + |
| SEQ ID NO: 306 | Y274M | + | |
| SEQ ID NO: 307 | Y274Q | + | |
| SEQ ID NO: 308 | T276S | + | |
| SEQ ID NO: 309 | L279F | ++ | |
| SEQ ID NO: 310 | I280F | ++ | |
| SEQ ID NO: 311 | I280W | ++ | |
| SEQ ID NO: 312 | A282G | | + |
| SEQ ID NO: 313 | A282H | | + |
| SEQ ID NO: 314 | A282K | | ++ |
| SEQ ID NO: 315 | A282N | | ++ |
| SEQ ID NO: 316 | A282R | | ++ |
| SEQ ID NO: 317 | S283C | + | |
| SEQ ID NO: 318 | S283F | ++ | |
| SEQ ID NO: 319 | S283I | ++ | |
| SEQ ID NO: 320 | S283M | ++ | |
| SEQ ID NO: 321 | S283T | + | |
| SEQ ID NO: 322 | S283W | ++ | |
| SEQ ID NO: 323 | R306F | | ++ |
| SEQ ID NO: 324 | R306H | | + |
| SEQ ID NO: 325 | R306L | | + |
| SEQ ID NO: 326 | R306N | | + |
| SEQ ID NO: 327 | G309A | + | + |

-continued

| SEQ ID | SDPS Variant | 7 uM Herbicide X (922) | 7 uM Herbicide Y (665) |
|---|---|---|---|
| SEQ ID NO: 328 | G309F | + | + |
| SEQ ID NO: 329 | G309M | + | |
| SEQ ID NO: 330 | G309S | ++ | |
| SEQ ID NO: 331 | F310G | + | + |
| SEQ ID NO: 332 | L310D | | ++ |
| SEQ ID NO: 333 | L310E | + | + |
| SEQ ID NO: 334 | L310F | | ++ |
| SEQ ID NO: 335 | L310H | | ++ |
| SEQ ID NO: 336 | L310N | + | + |
| SEQ ID NO: 337 | L310Q | + | + |
| SEQ ID NO: 338 | L310W | | ++ |
| SEQ ID NO: 339 | L310Y | | ++ |
| SEQ ID NO: 340 | F312C | + | |
| SEQ ID NO: 341 | F312I | + | + |
| SEQ ID NO: 342 | F312L | | ++ |
| SEQ ID NO: 343 | F312M | + | + |
| SEQ ID NO: 344 | F312V | | + |
| SEQ ID NO: 345 | Q313A | + | + |
| SEQ ID NO: 346 | Q313C | + | + |
| SEQ ID NO: 347 | Q313D | + | + |
| SEQ ID NO: 348 | Q313S | + | + |
| SEQ ID NO: 349 | Q313T | ++ | |
| SEQ ID NO: 663 | N128Y | | + |
| SEQ ID NO: 664 | T183G | + | |
| SEQ ID NO: 665 | A184C | | + |

It is clear that some mutations provide increased tolerance to one of the herbicide selected or in some cases to both herbicides. In many instances the same mutation was recovered numerous times for each library and demonstrated a consistent pattern of tolerance to the herbicides. The data is displayed for a single example of each mutation of interest.

From this list of variants, a further selection was made of those which had strong tolerance to one of the herbicides or those which were tolerant to both herbicides. Assays were carried out on these variants to determine the IC50 values as described in example 2. Table 3 shows the IC50 data for each variant. The data clearly shows that the selected examples have significantly increased IC50 values towards one or more of the herbicides of interest.

TABLE 3

| SEQ ID | SDPS Variant | IC50 X (922) | IC50 Y (665) | IC50 Z (773) | IC50 W (655) |
|---|---|---|---|---|---|
| SEQ ID NO: 16 | Maize SDPS 2 | 6.5 | 6.9 | 0.14 | 0.29 |
| SEQ ID NO: 45 | L120R | 145.7 | <9.4 | 0.15 | 0.39 |
| SEQ ID NO: 48 | L123A | >150 | <9.4 | 0.35 | 0.32 |
| SEQ ID NO: 50 | L123D | 85.92 | <9.4 | 0.39 | 0.52 |
| SEQ ID NO: 51 | L123N | 123.7 | <9.4 | 0.24 | 0.29 |
| SEQ ID NO: 53 | L123W | >150 | <9.4 | 0.17 | 0.4 |
| SEQ ID NO: 62 | L131A | <9.4 | 72.9 | 0.3 | 4.26 |
| SEQ ID NO: 72 | P148I | 198.8 | <9.4 | 0.12 | 0.26 |
| SEQ ID NO: 73 | P148L | >150 | <9.4 | 0.13 | 0.3 |
| SEQ ID NO: 74 | P148M | 180.7 | 0.48 | 0.24 | 0.38 |
| SEQ ID NO: 76 | P148V | 305.1 | 8.51 | 0.17 | 0.31 |
| SEQ ID NO: 82 | L174F | 274.8 | 0.2 | 0.29 | 0.45 |
| SEQ ID NO: 83 | L174T | 3.609 | 204.8 | 0.29 | 1.88 |
| SEQ ID NO: 87 | E176A | <8.9 | 14.3 | | |
| SEQ ID NO: 92 | E176P | 147.3 | 33.5 | 0.64 | 1.26 |
| SEQ ID NO: 95 | I177C | 150 | <9.4 | 0.12 | 0.24 |
| SEQ ID NO: 96 | I177F | >150 | >150 | 1.74 | 22.1 |
| SEQ ID NO: 97 | I177L | 8.5 | >150 | 0.29 | 2.73 |
| SEQ ID NO: 99 | I177S | 35.4 | <8.9 | | |
| SEQ ID NO: 101 | I177Y | >150 | >150 | 1.57 | 8.82 |
| SEQ ID NO: 103 | I178Q | <9.4 | 33.6 | 0.14 | 0.39 |
| SEQ ID NO: 110 | M180W | >150 | <9.4 | 0.47 | 0.57 |
| SEQ ID NO: 111 | I181M | >150 | >150 | >2 | >165 |
| SEQ ID NO: 112 | I181N | 120.2 | >150 | >2 | 35.13 |
| SEQ ID NO: 113 | A184G | >150 | >150 | 0.09 | 40.11 |

TABLE 3-continued

| SEQ ID | SDPS Variant | IC50 X (922) | IC50 Y (665) | IC50 Z (773) | IC50 W (655) |
|---|---|---|---|---|---|
| SEQ ID NO: 114 | A184S | 96.4 | 55.7 | 0.07 | <0.26 |
| SEQ ID NO: 115 | A184T | 16.8 | <9.4 | 0.05 | 0.27 |
| SEQ ID NO: 116 | T183C | >150 | <9.4 | 0.41 | 0.41 |
| SEQ ID NO: 117 | T183Q | >150 | <9.4 | 0.07 | 0.21 |
| SEQ ID NO: 118 | S185A | >150 | 36 | | |
| SEQ ID NO: 119 | S185T | >150 | <9.4 | | |
| SEQ ID NO: 126 | H188I | >150 | >150 | >2 | >165 |
| SEQ ID NO: 127 | H188L | 116 | 72 | >2 | 47 |
| SEQ ID NO: 128 | H188M | 125.5 | 83.4 | >2 | 50.99 |
| SEQ ID NO: 129 | H188V | 132.5 | 9.4 | 1.02 | 17.83 |
| SEQ ID NO: 145 | Y208I | >150 | <9.4 | 0.09 | <0.26 |
| SEQ ID NO: 155 | G209N | 62.8 | 14.3 | 0.22 | 0.67 |
| SEQ ID NO: 156 | T210Y | <9.4 | >150 | 0.48 | >165 |
| SEQ ID NO: 157 | R211D | <9.4 | >150 | 1.11 | >165 |
| SEQ ID NO: 158 | R211E | <9.4 | >150 | 0.52 | >165 |
| SEQ ID NO: 159 | R211N | <9.4 | >150 | 0.32 | 91.92 |
| SEQ ID NO: 161 | R211V | <9.4 | >150 | 1.24 | 102.5 |
| SEQ ID NO: 162 | L215I | <9.4 | 77.8 | | |
| SEQ ID NO: 168 | F221W | <9.4 | >150 | | |
| SEQ ID NO: 174 | Q223F | >150 | >150 | | |
| SEQ ID NO: 177 | Q223I | 106.8 | >150 | | |
| SEQ ID NO: 179 | Q223L | 60.8 | 31.8 | | |
| SEQ ID NO: 182 | Q223Y | >150 | >150 | | |
| SEQ ID NO: 184 | S224I | >150 | >150 | | |
| SEQ ID NO: 186 | S224N | >150 | >150 | | |
| SEQ ID NO: 187 | S224Q | 110.6 | >150 | | |
| SEQ ID NO: 188 | S224T | >150 | >150 | | |
| SEQ ID NO: 189 | S224V | >150 | >150 | | |
| SEQ ID NO: 190 | S225C | 57.9 | >150 | | |
| SEQ ID NO: 191 | S225F | >150 | >150 | | |
| SEQ ID NO: 192 | S225H | >150 | >150 | | |
| SEQ ID NO: 193 | S225I | >150 | >150 | | |
| SEQ ID NO: 194 | S225K | >150 | >150 | | |
| SEQ ID NO: 195 | S225M | 100.4 | >150 | | |
| SEQ ID NO: 196 | S225N | >150 | >150 | | |
| SEQ ID NO: 197 | S225Q | >150 | >150 | | |
| SEQ ID NO: 199 | S225V | 121.2 | >150 | | |
| SEQ ID NO: 200 | S225Y | >150 | >150 | | |
| SEQ ID NO: 216 | L228C | >150 | >150 | | |
| SEQ ID NO: 218 | L228M | <9.4 | >150 | 0.25 | 2.3 |
| SEQ ID NO: 219 | L228T | 41.6 | >150 | >1 | >165 |
| SEQ ID NO: 220 | L228V | 59 | >150 | >2 | >165 |
| SEQ ID NO: 221 | A229H | >150 | >150 | | |
| SEQ ID NO: 223 | A229L | >150 | >150 | 1.12 | 28.44 |
| SEQ ID NO: 224 | A229M | >150 | >150 | >2 | >100 |
| SEQ ID NO: 225 | A229N | >150 | >150 | >2 | 22.32 |
| SEQ ID NO: 231 | K238N | >150 | >150 | 0.29 | 1.3 |
| SEQ ID NO: 236 | I240C | >150 | <9.4 | 0.68 | 1.04 |
| SEQ ID NO: 237 | I240W | >150 | <9.4 | 0.16 | 0.27 |
| SEQ ID NO: 241 | S241T | 25.3 | >150 | 0.24 | 3.76 |
| SEQ ID NO: 242 | V243A | >150 | 25.8 | | |
| SEQ ID NO: 243 | V243G | >150 | 31.4 | 0.27 | 1.31 |
| SEQ ID NO: 244 | V243N | >150 | <9.4 | | |
| SEQ ID NO: 245 | V243Q | >150 | <9.4 | | |
| SEQ ID NO: 246 | V243S | >150 | 27.9 | | |
| SEQ ID NO: 247 | I244A | >150 | >150 | | |
| SEQ ID NO: 248 | I244F | >150 | >150 | | |
| SEQ ID NO: 249 | I244G | >150 | >150 | | |
| SEQ ID NO: 250 | I244H | >150 | >150 | | |
| SEQ ID NO: 251 | I244K | >150 | >150 | | |
| SEQ ID NO: 252 | I244L | >150 | >150 | | |
| SEQ ID NO: 253 | I244M | >150 | >150 | | |
| SEQ ID NO: 255 | I244P | 134.6 | 28.8 | | |
| SEQ ID NO: 256 | I244Q | 45.4 | >150 | | |
| SEQ ID NO: 257 | I244S | >150 | >150 | | |
| SEQ ID NO: 258 | I244V | >150 | 10.9 | 0.3 | 0.79 |
| SEQ ID NO: 259 | I244Y | >150 | >150 | >2 | >100 |
| SEQ ID NO: 260 | K245F | >150 | >150 | | |
| SEQ ID NO: 263 | K245N | 76.3 | <9.4 | | |
| SEQ ID NO: 270 | D246T | 24.6 | <9.4 | 0.2 | 0.13 |
| SEQ ID NO: 271 | D246Y | >150 | 137 | | |
| SEQ ID NO: 273 | F247L | >150 | >150 | 1.17 | >100 |
| SEQ ID NO: 274 | F247M | >150 | >150 | >2 | >100 |
| SEQ ID NO: 275 | F247N | 70.4 | <9.4 | 0.31 | 0.38 |
| SEQ ID NO: 276 | F247V | >150 | >150 | >2 | >100 |
| SEQ ID NO: 277 | A248P | 22 | >150 | >2 | >100 |
| SEQ ID NO: 279 | S249E | >150 | >150 | | |

TABLE 3-continued

| SEQ ID | SDPS Variant | IC50 X (922) | IC50 Y (665) | IC50 Z (773) | IC50 W (655) |
|---|---|---|---|---|---|
| SEQ ID NO: 280 | S249F | 59.5 | <9.4 | 0.25 | 0.22 |
| SEQ ID NO: 281 | S249G | >150 | <9.4 | | |
| SEQ ID NO: 284 | S249N | 47.9 | >150 | | |
| SEQ ID NO: 285 | S249Q | 51.8 | >150 | | |
| SEQ ID NO: 286 | S249T | 17.8 | >150 | | |
| SEQ ID NO: 287 | S249V | 12.3 | >150 | 0.22 | 0.93 |
| SEQ ID NO: 291 | I252M | >150 | >150 | | |
| SEQ ID NO: 292 | I252V | 14.5 | >150 | | |
| SEQ ID NO: 293 | K253L | >150 | >150 | | |
| SEQ ID NO: 295 | A255W | <9.4 | >150 | 0.23 | 6.88 |
| SEQ ID NO: 297 | T257E | 17.8 | 68.6 | 0.2 | 0.8 |
| SEQ ID NO: 305 | Y274L | 133.6 | 97.7 | | |
| SEQ ID NO: 309 | L279F | >150 | <9.4 | 0.21 | 0.29 |
| SEQ ID NO: 310 | I280W | >150 | <9.4 | 0.39 | 0.6 |
| SEQ ID NO: 311 | I280F | >150 | 42.7 | 0.26 | 0.25 |
| SEQ ID NO: 314 | A282K | 16 | >150 | | |
| SEQ ID NO: 315 | A282N | 34.2 | >150 | | |
| SEQ ID NO: 316 | A282R | >150 | >150 | | |
| SEQ ID NO: 318 | S283F | >150 | 27.4 | | |
| SEQ ID NO: 320 | S283M | >150 | 22 | | |
| SEQ ID NO: 323 | R306F | <9.4 | >150 | | |
| SEQ ID NO: 328 | G309A | >150 | 31.5 | 0.21 | 0.29 |
| SEQ ID NO: 332 | L310D | <9.4 | >150 | | 0.26 |
| SEQ ID NO: 334 | L310F | <9.4 | 113.7 | 0.12 | 0.17 |
| SEQ ID NO: 327 | F310G | >150 | >150 | | |
| SEQ ID NO: 335 | L310H | <9.4 | 145.9 | 0.13 | 0.22 |
| SEQ ID NO: 336 | L310N | <9.4 | 93.5 | 0.08 | 0.16 |
| SEQ ID NO: 337 | L310Q | >150 | >150 | 0.18 | 0.39 |
| SEQ ID NO: 338 | L310W | <9.4 | 94.6 | 0.13 | 0.21 |
| SEQ ID NO: 339 | L310Y | <9.4 | >150 | 0.14 | 0.24 |

Example 4. SDPS Sequences and Expression in Plants

*Arabidopsis* SDPS or orthologues of this (see full length SDPS sequences including chloroplast transit peptides), for example SEQ ID Nos. 1-12 expressed in transgenic tobacco. DNA sequences that encode these polypeptides (optimized for tobacco or. optionally, codon optimized according to a target crop such as soybean) are prepared synthetically. Each sequence is designed to include a 5' fusion with TMV omega 5' leader sequence and such they are flanked at the 5' end with XhoI and at the 3' end with KpnI to facilitate direct cloning into a suitable binary vector for *Agrobacterium*-based plant transformation.

In one example, the expression cassette, comprising the TMV omega 5' leader and a SDPS encoding gene of interest is excised using XhoI/KpnI and cloned into similarly digested pBIN 19 (Bevan, Nucl. Acids Res. (1984) behind a double enhanced 35S promoter ahead of a NOS 3' transcription terminator and then transformed into *E. coli* DHS alpha competent cells. DNA recovered from the *E. coli* is used to transform *Agrobacterium tumefaciens* LBA4404, and the transformed bacteria are selected on media contain rifampicin and kanamycin. Tobacco tissue is subjected to *Agrobacterium*-mediated transformation using methods well described in the art or as described herein. For example, a master plate of *Agrobacterium tumefaciens* containing the SDPS expressing binary vector is used to inoculate 10 ml LB (L broth) containing 100 mg/l Rifampicin plus 50 mg/l Kanamycin using a single bacterial colony. This is incubated overnight at 28° C. shaking at 200 rpm. This entire overnight culture is used to inoculate a 50 ml volume of LB containing the same antibiotics. Again this is cultured overnight at 28° C. shaking at 200 rpm. The *Agrobacterium* cells are pelleted by centrifuging at 3000 rpm for 15 minutes and then re-suspended in MS (Murashige and Skoog) medium containing 30 g/l sucrose, pH 5.9 to an OD (600 nM)=0.6. This suspension is dispensed in 25 ml aliquots into petri dishes.

Clonally micro-propagated tobacco shoot cultures am used to excise young (not yet fully expanded) leaves. The mid rib and outer leaf margins are removed and discarded, and the remaining lamina cut into 1 cm squares. These are transferred to the *Agrobacterium* suspension for 20 minutes. Explants are then removed, dabbed on sterile filter paper to remove excess suspension, then transferred onto solid NBM medium (MS medium containing 30 g/l sucrose, 1 mg/l BAP (benzylaminopurine) and 0.1 mg/l NAA (napthalene acetic acid) at pH 5.9 and solidified with 8 g/l Plantagar), with the abaxial surface of each explant in contact with the medium. Approximately 7 explants are transferred per plate, which are then sealed and maintained in a lit incubator at 25° C. for a 16 hour photoperiod for 3 days.

Explants are then transferred onto NBM medium containing 100 mg/l Kanamycin plus antibiotics to prevent further growth of *Agrobacterium* (200 mg/l timentin with 250 mg/l carbenicillin). Further subculture onto this same medium was then performed every 2 weeks.

As shoots start to regenerate from the callusing leaf explants, these are removed to Shoot elongation medium (MS medium, 30 g/l sucrose, 8 g/l Plantagar, 100 mg/l Kanamycin, 200 mg/l timentin, 250 mg/l carbenicillin, pH 5.9). Stable transgenic plants readily root within 2 weeks. To provide multiple plants per event to ultimately allow more than one herbicide test per transgenic plant, all rooting shoots are micro propagated to generate 3 or more rooted clones.

Putative transgenic plants that are rooting and showing vigorous shoot growth on the medium incorporating Kanamycin arc analysed by PCR using primers that amplified a 500 bp fragment specific to the SDPS transgene of interest. Evaluation of this same primer set on untransformed tobacco showed conclusively that these primers would not amplify any sequences from the native tobacco genome.

Transformed shoots are divided into 2 or 3 clones and regenerated from kanamycin resistant callus. Shoots are rooted on MS agar containing kanamycin. Surviving rooted explants are re-rooted to provide approximately 40-50 kanamycin resistant and PCR positive events from each event.

Once rooted, plantlets are transferred from agar and potted into 50% peat, 50% John Innes Soil No. 3 with slow-release fertilizer in 3 inch round pots and left regularly watered to establish for 8-12d in the glass house. Glass house conditions are about 24-27° C. day; 18-21° C. night and approximately a 14 h photoperiod. Humidity is adjusted to −65% and light levels used are up to 2000 μmol/$m^2$ at bench level.

Transgenic populations of about forty tobacco plants that comprise a gene encoding a full length SDPS gene (e.g. Seq ID No 2) are thus produced. Plants are selected on the basis of similar size from each population and ELISA or Mass Western tests are carried out to monitor protein transgenic SDPS expression levels. The highest expressing TO lines are selected to be taken forward to self and to generate T1 seed and T2 lines and seed in the normal way. Seeds from the highest expressing lines are tested for germination on agar plates containing a range of concentrations of SDPS-inhibiting herbicides as taught for example herein and resistant plant lines selected as showing the least damage to root growth and morphology at the highest concentrations of herbicides. Resistant plant lines exhibit a dose response in respect of herbicidal damage by SDPS inhibitors that is shifted to the right in comparison with similarly grown and treated wild type and null segregant plants.

Example 5: Assay of Herbicide Tolerance in Transgenic Tobacco

Populations of transgenic tobacco comprising 20-30 transgenic events per plant transformation constructs were generated as described in example 4. These lines were clonally propagated and 1 clone per event was sprayed with 1000 g/ha of Herbicide Compound 1. Herbicidal damage was visually assessed across the population and a herbicide damage score given at 7 and 14 days. A score of 1 indicates no visible damage or stunting whereas a score of 100 indicates a complete death of the plant.

The results in FIG. 3 show the damage scores for 4 populations of plants expressing either *Arabidopsis* SDPS2 gene (SEQ ID NO.2), the *Arabidopsis* SDPS2 F240L mutated gene (SEQ ID NO.3). the *Chlorella fusca* SDPS gene (SEQ ID NO. 10) or the *Chlorella fusca* SDPS F227L mutated gene (SEQ ID NO.11). A control population of wild-type Samsun tobacco was also assessed for herbicide damage. The averaged damage scores across the population if transgenic plants for each construct is given in Table 4. It is clear that the overexpression of *Chlorella fusca* SDPS (SEQ ID NO. 10) gene does not increase tolerance to Herbicide Compound Ex. 1 however the mutated version of the gene carrying the F227L mutation (SEQ ID NO.11) does display increased tolerance. The *Arabidopsis* gene (SEQ ID NO.2) performs better than the *Chlorella* wild-type gene in terms of herbicide tolerance and this tolerance is again improved by the addition of the F240L mutation (SEQ ID NO.3).

TABLE 4

| Construct | Average Damage (%) |
|---|---|
| WT Control | 23.125 |
| pBin TMV CfSDPS | 25 |
| pBin TMV CfSDPS_F227L | 10.05 |
| pBin TMV AraSDPS2 | 13.25 |
| pBin TMV AraSDPS2_F240L | 5 |

A further set of transgenic tobacco overexpressing the *Arabidopsis* SDPS F240L gene (SEQ ID NO.3) were created as described above. These plants were sprayed with 75 g/ha Aclonifen or 25 g/ha herbicide Z. The plants were assessed for herbicide damage at 7 days post treatment and compared to wild-type tobacco plants. The herbicide damage scores are shown in table 5.

TABLE 5

| | Arabidopsis SDPS2 F240L gene (SEQ ID NO. 3) | | Wild type Tobacco | |
|---|---|---|---|---|
| Event Number | Aclonifen 75 g/ha | Herbicide Z 25 g/ha | Aclonifen 75 g/ha | Herbicide Z 25 g/ha |
| 3772 | 10 | 0 | 35 | 20 |
| 3775 | 10 | 0 | 35 | 10 |
| 3776 | 15 | 0 | 35 | 30 |
| 3777 | 15 | 0 | 35 | 25 |
| 3779 | 20 | 5 | 30 | 30 |
| 3780 | 20 | 0 | 30 | 25 |
| 3781 | 15 | 10 | 60 | 15 |
| 3785 | 15 | 0 | 60 | 20 |
| 3786 | 10 | 0 | | |
| 3787 | 10 | 0 | | |

TABLE 5-continued

| | Arabidopsis SDPS2 F240L gene (SEQ ID NO. 3) | | Wild type Tobacco | |
|---|---|---|---|---|
| Event Number | Aclonifen 75 g/ha | Herbicide Z 25 g/ha | Aclonifen 75 g/ha | Herbicide Z 25 g/ha |
| 3790 | 10 | 0 | | |
| 3791 | 0 | 0 | | |
| 3796 | 5 | 0 | | |
| 3800 | 5 | 0 | | |
| 3803 | 0 | 0 | | |
| 3804 | 5 | 0 | | |
| 3806 | 10 | 0 | | |
| 3809 | 5 | 0 | | |
| 3810 | 30 | 35 | | |
| 3812 | 25 | 30 | | |
| 3814 | 25 | 5 | | |
| 3815 | 25 | 15 | | |
| 3816 | 30 | 10 | | |
| 3836 | 25 | 5 | | |
| 3838 | 20 | 0 | | |
| 3841 | 5 | 0 | | |
| 3842 | 35 | 0 | | |
| 3844 | 25 | 10 | | |
| 3847 | 35 | 10 | | |
| 3848 | 25 | 10 | | |

Numerous transgenic tobacco events expressing the *Arabidopsis* SDPS2 F240L gene (SEQ ID NO.3) show no damage from the herbicide treatment in contrast to the damage seen on the control plants. The average herbicide damage scores for the transgenic tobacco population versus the control wild-type plants are shown in table 6.

TABLE 6

| | Aclonifen 75 g/ha | Herbicide Z 25 g/ha |
|---|---|---|
| pBin AraSDPS2 F240L | 16.16666667 | 4.833333333 |
| Wild type | 40 | 21.875 |

The result show a clear increased tolerance to the herbicides in the transgenic lines expressing the *Arabidopsis* SDPS2 F240L gene (SEQ ID NO.3).

Example 6: Assay of Tolerance of Transgenic Tobacco T1 Lines in Liquid Culture

Seed Sterilization:

*Nicotiana tabacum* Samsun wild type and transgenic lines were sterilized by placing in 30 ml Universals containing approximately 15 ml freshly made 2% Virkon and rotated on a roller for 15 mins. The Virkon was pipetted off using an extended fine tip mini pastette and the seed washed 4 times with 1% PPM (Plant Preservative Mixture, P820, 250 ml. Apollo Scientific Ltd.)

Seed Germination:

Seed was germinated on 90 mm Petri dishes containing 1/3 MS+0.8% agarose (SPI, Duchefa #DU 0463). pH5.7 (for WT) and 1/3 MS+0.8% agarose+100 ug/ml kanamycin (for the transgenic). Approximately 100 seed of each was spread on to each Petri dish. NB the transgenic seed is not homozygous therefore was plated on Kan to select. (MS=Murashige & Skoog MS Medium, #M0221, Melford Labs).

Plates were placed in a clear plastic "incubating box" (lids under plate) and incubated in a controlled environment room with the following conditions:

Temperature: Day 25° C./Night 25° C.

Light settings: Photo period 16 hours, Light level ~50 $\mu mol/m^2/s$

Dose Response Test:

7 day old tobacco plantlets (3 plantlets per well) were transferred aseptically to 24 well plates (cell-culture cluster flat bottom with lid) (Corning Costar #3524) containing 2 ml % MS+30 mM sucrose (Fisher #10638403), pH5.7 per well. Herbicide 2 was two-fold serially diluted in DMSO starting at 10 ppm and added to the media. DMSO only was added to the zero compound control wells. NB. The final concentration of DMSO did not exceed 0.5% since this is inhibitory to the plantlets.

Plates were placed in clear plastic "Incubating boxes" (lid under plate) and incubated for 2 weeks in a controlled environment room with the following conditions:

Temperature: Day 24° C./Night 18° C.

Light settings: Photo period 16 hours, Light level 600 $\mu mol/m^2/s$.

Assessment:

Plantlets were assessed visually for bleaching symptomology after 7 days and a damage score given for each well. Each plate was replicated and both damage scores are given in Table 7.

TABLE 7

| Tobacco Line | 10 ppm | 5 ppm | 2.5 ppm | 1.25 ppm | 0.75 ppm | DMSO |
|---|---|---|---|---|---|---|
| WT (Samsun) | 95/100 | 95/90 | 50/50 | 0/0 | 0/0 | 0/0 |
| ARA SDPS1 | 100/100 | 100/100 | 50/50 | 0/0 | 0/0 | 0/0 |
| ARA SDPS1 | 100/100 | 90/80 | 50/25 | 0/0 | 0/0 | 0/0 |
| ARA SDPS1 | 100/100 | 80/95 | 25/25 | 0/0 | 0/0 | 0/0 |
| Tobacco Line | 10 ppm | 5 ppm | 2.5 ppm | 1.25 ppm | 0.75 ppm | 0 ppm |
| WT (Samsun) | 100/100 | 90/100 | 25/25 | 0/0 | 0/0 | 0/0 |
| ARA SDPS F240V 1 | 90/100 | 50/50 | 25/25 | 0/0 | 0/0 | 0/0 |
| ARA SDPS F240V 1 | 100/100 | 50/50 | 25/25 | 0/0 | 0/0 | 0/0 |
| ARA SDPS F240V 1 | 90/100 | 50/25 | 25/25 | 0/0 | 0/0 | 0/0 |

The presence of the F240L mutation reduces damage at the 5 ppm herbicide treatment although no significant advantage is seen at 10 ppm.

It should be understood that the examples and embodiments described herein are for illustrative purposes only and that various modifications or changes in light thereof of the description will be suggested to persons skilled in the art and are to be included within the spirit and purview of this application and the scope of the appended claims.

All publications and patent applications mentioned in this specification are indicative of the level of skill of those skilled in the art that this invention pertains. All publications and patent applications are herein incorporated by reference to the same extent as if each individual publication or patent application was specifically and individually indicated to be incorporated by reference.

SEQUENCE LISTING (668 sequences)

SEQ ID NO: 1 - protein, 406 aa, Arabidopsis thaliana 	;
MMTSCRNIDLGTMMMACGCGRRQFPSLAKTVCKFTSSNRSYGGLVGSCKAVPTKSKEISLLNGIGQSQTVSFDLKQESKQPISLVTLFELVAVDLQTLNDNLLSIVGAENPVLISAAEQIFGAGGKRMRPGLVFLVSHATAELAGLKELTTEHRRLAEIIEMIHTASLIHDDVLDESDMRRGKETVHELFGTRVAVLAGDFMFAQASWYLANLENLEVIKLISQVIKDFASGEIKQASSLFDCDTKLDEYLLKSFYKTASLVAASTKGAAIFSRVEPDVTEQMYEFGKNLGLSFQIVDDILDFTQSTEQLGKPAGSDLAKGNLTAPVIFALEREPRLREIIESEFCEAGSLEEAIEAVTKGGGIKRAQELAREKADDAIKNLQCLPRSGFRSALEDMVLYNLERID

SEQ ID NO: 2 - protein, 417 aa, Arabidopsis thaliana 	;
MMMSCRNIDLGTSVLDHSCSSSSTSRRFLFGNSSKTVCMIGGRSCVGNLVFLRRDLATCRAVPAKSKENSLVNGIGQDQTVMLNLRQESRKPISLETLFEVVADDLQRLNDNLLSIVGAENPVLISAAEQIFSAGGKRMRPGLVFLVSRATAELAGLKELTVEHRRLGEIIEMIHTASLIHDDVLDESDMRRGRETVHELFGTRVAVLAGDFMFAQASWYLANLENLEVIKLISQVIKDFASGEIKQASSLFDCDVKLDDYMLKSYYKTASLVAASTKGAAIFSKVESKVAEQMYQFGKNLGLSFQVVDDILDFTQSTEQLGKPAANDLAKGNITAPVIFALENEPRLREIIESEFCEPGSLEEAIEIVRNRGGIKKAQELAKEKAELALKNLNCLPRSGFRSALEDMVMFNLERID

SEQ ID NO: 3 - protein, 417 aa, Artificial Sequence;
  Artificial SDPS
MMMSCRNIDLGTSVLDHSCSSSSTSRRFLFGNSSKTVCMIGGRSCVGNLVFLRRDLATCRAVPAKSKENSLVNGIGQDQTVMLNLRQESRKPISLETLFEVVADDLQRLNDNLLSIVGAENPVLISAAEQIFSAGGKRMRPGLVFLVSRATAELAGLKELTVEHRRLGEIIEMIHTASLIHDDVLDESDMRRGRETVHELFGTRVAVLAGDFMFAQASWYLANLENLEVIKLISQVIKDLASGEIKQASSLFDCDVKLDDYMLKSYYKTASLVAASTKGAAIFSKVESKVAEQMYQFGKNLGLSFQVVDDILDFTQSTEQLGKPAANDLAKGNITAPVIFALENEPRLREIIESEFCEPGSLEEAIEIVRNRGGIKKAQELAKEKAELALKNLNCLPRSGFRSALEDMVMFNLERID

SEQ ID NO: 4 - protein, 407 aa, Zea mays 	;
MLSLSCSCPGVSSMSKTALDWGHLVASCRSRWHGARAPPRRRRTPCVCLAASPTTTQPGPAAVDVPSRTVPAVTTSSAPERISVSALLEVVSNDLLNLNNNLKSLVGAENPVLVSAAEQIFSAGGKRLRPALVFLVSRATAELAALPELTTEHRRLAEIIEMIHTASLIHDDVIDDSGMRRGKETIHQLYGTRVAVLAGDFMFAQSSWFLANLENIEVIKLISQVIKDFASGEIKQASTLFDCDVTLDDYLLKSYYKTASLIAASTRSAAIFSGVGSGVCEQMYEYGRNLGLAFQVVDDILDLTQSAEQLGKPAAGSDLAKGNLTAPVILALREEPRLRGIIESEFCEPGSLAAAVELVHRGGGIRSARELAEEKGGLALRSLQCLPRSEFRSALERVVHYNLQRVR

SEQ ID NO: 5 - protein, 424 aa, Zea mays 	;
MAAAPSSLASSSHIPRRATATAPAQSHSPPLPQQLRPARSFKRGALAQHVRYSFAGREASRRRTPGACFVVSSSQPGLAAIDVPAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLYGTRVAVLAGDFMFAQSSWFLANLENIEVIKLISQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 6 - protein, 402 aa, Triticum aestivum 	;
MLSVSSPRMHMSRNAVDLGLLAACRCRRWAARPAPRRRAPCVCFVAAPSQTGLAAIDVPAAETIASAAAGTARLPERVSIASLLDVVSDDLLKLNNNLKSLIGAENPVLVSAAEQIFGAGGKRLRPALVFLVSRATAEVAGLSELTTEHKRLAEIIEMIHTASLIHDDVIDDSGMRRGKETIHQLYGTRIAVLAGDFMFAQSSWFLANLENIEVIKLISQVIKDFASGEIKQQSTLFDCDVTLDDYLLKSYYKTASLLASSTRSAAIFSGVSTAVCEQMYEYGRNLGLSFQVVDDILDFTQSAEQLGKPAGSDLAKGNLTAPVIFALQESPELREIIDSEFCDTGSLSAAMELVHRSGGIRRAQELAKEKGDLALQNLQCLPRSHFRTALENMVKYNLERID

SEQ ID NO: 7 - protein, 394 aa, Hordeum vulgare 	;
MLSVSSPRMHMSRNVVDLGLLAACRCRRWAARPAPRRRAPCVCFVAAPSQTGLAAIDVPAAGTARLPERVSIASLLDVVSDDLLKLNNNLKSLIGAENPVLVSAAEQIFGAGGKRLRPALVFLVSRATAEVAGLSELTTEHKRLAEIIEMIHTASLIHDDVIDDSGMRRGKETIHQLYGTRIAVLAGDFMFAQSSWFLANLENIEVIKLISQVIKDFASGEIKQQSTLFDCDVTLDDYLLKSYYKTASLLASSTRSAAIFSGVSTTVCEQMYEYGRNLGLSFQVVDDILDFTQSAEQLGKPAGSDLAKGNLTAPVIFALQESPELREIIDSEFCDTGSLSAAMELVHKSGGIRRAQELAKEKGDLALQNLQCLPRSHFRTALENMVTYNLERID

SEQ ID NO: 8 - protein, 423 aa, Glycine Max 	;
MMSVTGKGIDFAGKNLVSGCSSNASFDWYTVRNYAKANSNNSNGCGRGHGRKLVCCKRRSTQCRVSSMKTAQPTVNGGTHAIEGLTTGLNLKGYSEAPISPARFFEAVADDLLILNKNLQSIVGAENPVLMSAAEQIFSAGGKRMRPALVFLVSRATAELLGLKELTVKHRRLAEIIEMIHTASLIHDDVLDESDLRRGKKTVHQMFGTRVAVLAGDFMFAQSSWYLANLENIEVIKLISQVIKDFASGEIKQASSLFDCDVQLDEYLIKSYYKTASLIAASTKGAAIFSGADSSVTEKMYEYGKNLGLSFQVVDDILDFTQSAEQLGKPAGSDLAKGNLTAPVIFALEKEPKLRDIIESEFSEVGSLDEAINLVKSCGGIERAQELAKEKADLAIQSLQCLPQSVFRLALEDMVAYNLQRIA

SEQ ID NO: 9 - protein, 403 aa, Oryza sativa 	;
MLSVSCPRVYMSRKALDFGQLASCRCRWAGRSGMRVAPRRRMPCVCFVASPSQPGLAAVDVPAEAISSARTTTMIPERISVSSLLEVVSDDLLKLNNNLKSLVGAENPVLVSAAEQIFGAGGKRLRPALVFLVSRATAELAGLLELTTEHQRLAEIIEMIHTASLIHDDVIDDSGMRRGKETIHQLYGTRVAVLAGDFMFAQSSWFLANLENIEVIKLISQVIKDFASGEIKQASTLFDCDVTLDDYLLKSYYKTASLLASSTRSAAIFSGVSTTICEQMYEYGRNLGLSFQVVDDILDFTQSAEQLGKPAGSDLAKGNLTAPVIFALQDEPKLREIIDSEFSESDSLATAIDLVHRSGGIRRAQELAKEKGDLALQNLQCLPKSQFRSTLENVVKYNLQRID

SEQ ID NO: 10 - protein, 404 aa, Chlorella fusca 	;
MQSSVMQRAANTTSHTTFTIRTSPRAPCSCIHGQIHHQFAVPRTAQPNFDSVRPRVLIASEASVQTAPSPSYPEKVQPADLITQIIHPVAADMQQMNHNLRNIVGERSPMLMAAADQIFGAGGKKLRPMIVFLVARATANLAGMDDITERHRRLAEIIEMIHTASLVHDDVLDDCAVRRGKQTVNTLYGTRVAVLAGDFLFAQASWLIANLENLEVIKLISKVIADFANGEISQASSLFDTEVTLQQYLDKSFYKTASLIAASCRSSAVFSGMGEEEKEAMYNYGKHLGLAFQVVDDILDFTQTAEQLGKPQGQDLASGNLTAPVIFALNHSSELESIIQSEFTEQDSLQRALALVNSAGGIQAARDLAESEADLARQALSCLRDCPAKRSLELMVDYVLERIH

SEQ ID NO: 11 - protein, 404 aa, Artificial Sequence; 		;
  Artificial SDPS
MQSSVMQRAANTTSHTTFTIRTSPRAPCSCIHGQIHHQFAVPRTAQPNFDSVRPRVLIASEASVQTAPSPSYPEKVQPADLITQIIHPVAADMQQMNHNLRNIVGERSPMLMAAADQIFGAGGKKLRPMIVFLVARATANLAGMDDITERHRRLAEIIEMIHTASLVHDDVLDDCAVRRGKQTVNTLYGTRVAVLAGDFLFAQASWLIANLENLEVIKLISKVIADLANGEISQASSLFDTEVTLQQYLDKSFYKTASLIAASCRSSAVFSGMGEEEKEAMYNYGKHLGLAFQVVDDILDFTQTAEQLGKPQGQDLASGNLTAPVIFALNHSSELESIIQSEFTEQDSLQRALALVNSAGGIQAARDLAESEADLARQALSCLRDCPAKRSLELMVDYVLERIH

SEQ ID NO: 12 - protein, 394 aa, Chlamydomonas reinhardtii 	;
MGLYNVTIPERMSLPETVGCSSRCLPRPQPRLLRAGRQPARPVVRTRVYTPTRAEEQTALRLEAQLAPANLLSEILAPVTADMQQMNTNLKNVVGNRHPMLMAAAEQIFGAGGKKLRPVIVFLVAHCTAQREGLTELTEKHRRLAEITEMIHTASLVHDDVLDECDIRRGKQTINSMYGTRVAVLAGDFLFAQSSWFLANLDNLEVIKLISQVIADFANGEISQAASLFDTDITLEQYLDKSFYKTASLIAASCRSAAVFSDSPVEVKEAMYAYGKHLGLAFQVVDDILDFTQTSEQLGKPQGQDLASGNLTAPVIFALRKSPELLDIISSEFVEEGSLQRALQLVNETGGIEEARLLARQQADLALSALECLPEGSSRRSLRLMVDYVLDRIY

SEQ ID NO: 13 - protein, 370 aa, Artificial Sequence; 		;
  Artificial SDPS
MHHHHHHENLYFQAVPAKSKENSLVNGIGQDQTVMLNLRQESRKPISLETLFEVVADDLQRLNDNLLSIVGAENPVLISAAEQIFSAGGKRMRPGLVFLVSRATAELAGLKELTVEHRRLGEIIEMIHTASLIHDDVLDESDMRRGRETVHELFGTRVAVLAGDFMFAQASWYLANLENLEVIKLISQVIKDFASGEIKQASSLFDCDVKLDDYMLKSYYKTASLVAASTKGAAIFSKVESKVAEQMYQFGKNLGLSFQVVDDILDFTQSTEQLGKPAANDLAKGNITAPVIFALENEPRLREIIESEFCEPGSLEEAIEIVRNRGGIKKAQELAKEKAELALKNLNCLPRSGFRSALEDMVMFNLERID

SEQ ID NO: 14 - protein, 394 aa, Artificial Sequence; 		;
  Artificial SDPS
MHHHHHHGNSSKTVCMIGGRSCVGNLVFLRRDLATCRAVPAKSKENSLVNGIGQDQTVMLNLRQESRKPISLETLFEVVADDLQRLNDNLLSIVGAENPVLISAAEQIFSAGGKRMRPGLVFLVSRATAELAGLKELTVEHRRLGEIIEMIHTASLIHDDVLDESDMRRGRETVHELFGTRVAVLAGDFMFAQASWYLANLENLEVIKLISQVIKDLASGEIKQASSLFDCDVKLDDYMLKSYYKTASLVAASTKGAAIFSKVESKVAEQMYQFGKNLGLSFQVVDDILDFTQSTEQLGKPAANDLAKGNITAPVIFALENEPRLREIIESEFCEPGSLEEAIEIVRNRGGIKKAQELAKEKAELALKNLNCLPRSGFRSALEDMVMFNLERID

SEQ ID NO: 15 - protein, 367 aa, Artificial Sequence; 		;
  Artificial SDPS
MHHHHHHCLAASPTTTQPGPAAVDVPSRTVPAVTTSSAPERISVSALLEVVSNDLLNLNNNLKSLVGAENPVLVSAAEQIFSAGGKRLRPALVFLVSRATAELAALPELTTEHRRLAEIIEMIHTASLIHDDVIDDSGMRRGKETIHQLYGTRVAVLAGDFMFAQSSWFLANLENIEVIKLISQVIKDFASGEIKQASTLFDCDVTLDDYLLKSYYKTASLIAASTRSAAIFSGVGSGVCEQMYEYGRNLGLAFQVVDDILDLTQSAEQLGKPAAGSDLAKGNLTAPVILALREEPRLRGIIESEFCEPGSLAAAVELVHRGGGIRSARELAEEKGGLALRSLQCLPRSEFRSALERVVHYNLQRVR

SEQ ID NO: 16 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLYGTRVAVLAGDFMFAQSSWFLANLENIEVIKLISQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 17 - protein, 367 aa, Artificial Sequence; 		;
  Artificial SDPS
MHHHHHHCLAASPTTTQPGPAAVDVPSRTVPAVTTSSAPERISVSALLEVVSNDLLNLNNNLKSLVGAENPVLVSAAEQIFSAGGKRLRPALVFLVSRATAELAALPELTTEHRRLAEIIEMIHTASLIHDDVIDDSGMRRGKETIHQLYGTRVAVLAGDFMFAQSSWFLANLENIEVIKLISQVIKDLASGEIKQASTLFDCDVTLDDYLLKSYYKTASLIAASTRSAAIFSGVGSGVCEQMYEYGRNLGLAFQVVDDILDLTQSAEQLGKPAAGSDLAKGNLTAPVILALREEPRLRGIIESEFCEPGSLAAAVELVHRGGGIRSARELAEEKGGLALRSLQCLPRSEFRSALERVVHYNLQRVR

SEQ ID NO: 18 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLYGTRVAVLAGDFMFAQSSWFLANLENIEVIKLISQVIKDLASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 19 - DNA, 13564 bp, Artificial Sequence;
  Plasmid
cgagctcgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattcctagagatcatgagcggagaattaagggagtcacgttatgacccccgccgatgacgcgggacaagccgttttacgtttggaactgacagaaccgcaacgttgaaggagccactcagccgcgggtttctggagtttaatgagctaagcacatacgtcagaaaccattattgcgcgttcaaaagtcgcctaaggtcactatcagctagcaaatatttcttgtcaaaaatgctccactgacgttccataaattcccctcggtatccaattagagtctcatattcactctcaatccaaataatctgcaccggatctggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccacgggatctctgcggaacaggcggtcgaaggtgccgatatcattacgacagcaacggccgacaagcacaacgccacgatcctgagcgacaatatgatcgggcccggcgtccacatcaacggcgtcggcggcgactgcccaggcaagaccgagatgcaccgcgatatcttgctgcgttcggatattttcgtggagttcccgccacagacccggatgatccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggcctcctgtcaatgctggcggcggctctggtggtggttctggtggcggctctgagggtggtggctctgagggtggcggttctgagggtggcggctctgagggaggcggttccggtggtggctctggttccggtgattttgattatgaaaagatggcaaacgctaataagggggctatgaccgaaaatgccgatgaaaacgcgctacagtctgacgctaaaggcaaacttgattctgtcgctactgattacggtgctgctatcggcctgaatggcgcccgctcctttcgctttcttcccttcctttctcgccacgttcgccggctttccccgtcaagctctaaatcgggggctccctttagggttccgatttagtgctttacggcacctcgaccccaaaaaacttgatttgggtgatggttcacgtagtgggccatcgccctgatagacggtttttcgccctttgacgttggagtccacgttctttaatagtggactcttgttccaaactggaacaacactcaaccctatctcgggctattcttttgatttataagggattttgccgatttcggaaccaccatcaaacaggattttcgcctgctggggcaaaccagcgtggaccgcttgctgcaactctctcagggccaggcggtgaagggcaatcagctgttgcccgtctcactggtgaaaagaaaaaccaccccagtacattaaaaacgtccgcaatgtgttattaagttgtctaagcgtcaatttgtttacaccacaatatatcctgccaccagccagccaacagctccccgaccggcagctcggcacaaaatcaccactcgatacaggcagcccatcagtccgggacggcgtcagcgggagagccgttgtaaggcggcagactttgctcatgttaccgatgctattcggaagaacggcaactaagctgccgggtttgaaacacggatgatctcgcggagggtagcatgttgattgtaacgatgacagagcgttgctgcctgtgatcaaatatcatctccctcgcagagatccgaattatcagccttcttattcatttctcgcttaaccgtgacaggctgtcgatcttgagaactatgccgacataataggaaatcgctggataaagccgctgaggaagctgagtggcgctatttctttagaagtgaacgttgacgatatcaactcccctatccattgctcaccgaatggtacaggtcggggacccgaagttccgactgtcggcctgatgcatccccggctgatcgaccccagatctggggctgagaaagcccagtaaggaaacaactgtaggttcgagtcgcgagatcccccggaaccaaaggaagtaggttaaacccgctccgatcaggccgagccacgccaggccgagaacattggttcctgtaggcatcgggattggcggatcaaacactaaagctactggaacgagcagaagtcctccggccgccagttgccaggcggtaaaggtgagcagaggcacgggaggttgccacttgcgggtcagcacggttccgaacgccatggaaaccgcccccgccaggcccgctgcgacgccgacaggatctagcgctgcgtttggtgtcaacaccaacagcgccacgcccgcagttccgcaaatagcccccaggaccgccatcaatcgtatcgggctacctagcagagcggcagagatgaacacgaccatcagcggctgcacagcgcctaccgtcgccgcgaccccgcccggcaggcggtagaccgaaataaacaacaagctccagaatagcgaaatattaagtgcgccgaggatgaagatgcgcatccaccagattcccgttggaatctgtcggacgatcatcacgagcaataaacccgccggcaacgcccgcagcagcataccggcgacccctcggcctcgctgttcgggctccacgaaaacgccggacagatgcgccttgtgagcgtccttggggccgtcctcctgtttgaagaccgacagcccaatgatctcgccgtcgatgtaggcgccgaatgccacggcatctcgcaaccgttcagcgaacgcctccatgggctttttctcctcgtgctcgtaaacggacccgaacatctctggagctttcttcagggccgacaatcggatctcgcggaaatcctgcacgtcggccgctccaagccgtcgaatctgagccttaatcacaattgtcaattttaatcctctgtttatcggcagttcgtagagcgcgccgtgcgtcccgagcgatactgagcgaagcaagtgcgtcgagcagtgcccgcttgttcctgaaatgccagtaaagcgctggctgctgaacccccagccggaactgaccccacaaggccctagcgtttgcaatgcaccaggtcatcattgacccaggcgtgttccaccaggccgctgcctcgcaactcttcgcaggcttcgccgacctgctcgcgccacttcttcacgcgggtggaatccgatccgcacatgaggcggaaggtttccagcttgagcgggtacggctcccggtgcgagctgaaatagtcgaacatccgtcgggccgtcggcgacagcttgcggtacttctcccatatgaatttcgtgtagtggtcgccagcaaacagcacgacgatttcctcgtcgatcaggacctggcaacgggacgttttcttgccacggtccaggacgcggaagcggtgcagcagcgacaccgattccaggtgcccaacgcggtcggacgtgaagcccatcgccgtcgcctgtaggcgcgacaggcattcctcggccttcgtgtaataccggccattgatcgaccagcccaggtcctggcaaagctcgtagaacgtgaaggtgatcggctcgccgataggggtgcgcttcgcgtactccaacacctgctgccacaccagttcgtcatcgtcggcccgcagctcgacgccggtgtaggtgatcttcacgtccttgttgacgtggaaaatgaccttgttttgcagcgcctcgcgcgggattttcttgttgcgcgtggtgaacagggcagagcgggccgtgtcgtttggcatcgctcgcatcgtgtccggccacggcgcaatatcgaacaaggaaagctgcatttccttgatctgctgcttcgtgtgtttcagcaacgcggcctgcttggcctcgctgacctgttttgccaggtcctcgccggcggtttttcgcttcttggtcgtcatagttcctcgcgtgtcgatggtcatcgacttcgccaaacctgccgcctcctgttcgagacgacgcgaacgctccacggcggccgatggcgcgggcagggcagggggagccagttgcacgctgtcgcgctcgatcttggccgtagcttgctggaccatcgagccgacggactggaaggtttcgcggggcgcacgcatgacggtgcggcttgcgatggtttcggcatcctcggcggaaaaccccgcgtcgatcagttcttgcctgtatgccttccggtcaaacgtccgattcattcaccctccttgcgggattgccccgactcacgccggggcaatgtgcccttattcctgatttgacccgcctggtgccttggtgtccagataatccaccttatcggcaatgaagtcggtcccgtagaccgtctggccgtccttctcgtacttggtattccgaatcttgccctgcacgaataccagcgaccccttgcccaaatacttgccgtgggcctcggcctgagagccaaaacacttgatgcggaagaagtcggtgcgctcctgcttgtcgccggcatcgttgcgccacatctaggtactaaaacaattcatccagtaaaatataatattttattttctcccaatcaggcttgatccccagtaagtcaaaaaatagctcgacatactgttcttccccgatatcctccctgatcgaccggacgcagaaggcaatgtcataccacttgtccgccctgccgcttctcccaagatcaataaagccacttactttgccatctttcacaaagatgttgctgtctcccaggtcgccgtgggaaaagacaagttcctcttcgggcttttccgtctttaaaaaatcatacagctcgcgcggatctttaaatggagtgtcttcttcccagttttcgcaatccacatcggccagatcgttattcagtaagtaatccaattcggctaagcggctgtctaagctattcgtatagggacaatccgatatgtcgatggagtgaaagagcctgatgcactccgcatacagctcgataatcttttcagggctttgttcatcttcatactcttccgagcaaaggacgccatcggcctcactcatgagcagattgctccagccatcatgccgttcaaagtgcaggacctttggaacaggcagctttccttccagccatagcatcatgtccttttcccgttccacatcataggtggtccctttataccggctgtccgtcatttttaaatataggttttcattttctcccaccagcttatataccttagcaggagacattccttccgtatcttttacgcagcggtatttttcgatcagttttttcaattccggtgatattctcattttagccatttattatttccttcctcttttctacagtatttaaagataccccaagaagctaattataacaagacgaactccaattcactgttccttgcattctaaaaccttaaataccagaaaacagctttttcaaagttgttttcaaagttggcgtataacatagtatcgacggagccgattttgaaaccacaattatgggtgatgctgccaacttactgatttagtgtatgatggtgtttttgaggtgctccagtggcttctgtttctatcagctgtccctcctgttcagctactgacggggtggtgcgtaacggcaaaagcaccgccggacatcagcgctatctctgctctcactgccgtaaaacatggcaactgcagttcacttacaccgcttctcaacccggtacgcaccagaaaatcattgatatggccatgaatggcgttggatgccgggcaacagcccgcattatgggcgttggcctcaacacgattttacgtcacttaaaaaactcaggccgcagtcggtaacctcgcgcatacagccgggcagtgacgtcatcgtctgcgcggaaatggacgaacagtggggctatgtcggggctaaatcgcgccagcgctggctgttttacgcgtatgacagtctccggaagacggttgttgcgcacgtattcggtgaacgcactatggcgacgctggggcgtcttatgagcctgcttcaccctttgacgtggtgatatggatgacggatggctggccgctgtatgaatcccgcctgaagggaaagctgcacgtaatcagcaagcgatatacgcagcgaattgagcggcataacctgaatctgaggcagcacctggcacggctgggacggaagtcgctgtcgttctcaaaatcggtggagctgcatgacaaagtcatcgggcattatctgaacataaaacactatcaataagttggagtcattacccaattatgatagaatttacaagctataaggttattgtcctgggtttcaagcattagtccatgcaagtttttatgctttgcccattctatagatatattgataagcgcgctgcctatgccttgccccctgaaatccttacatacggcgatatcttctatataaaagatatattatcttatcagtattgtcaatatattcaaggcaatctgcctcctcatcctcttcatcctcttcgtcttggtagctttttaaatatggcgcttcatagagtaattctgtaaaggtccaattctcgttttcatacctcggtataatcttacctatcacctcaaatggttcgctgggtttatcgcacccccgaacacgagcacggcacccgcgaccactatgccaagaatgcccaaggtaaaaattgccggccccgccatgaagtccgtgaatgccccgacggccgaagtgaagggcaggccgccacccaggccgccgccctcactgcccggcacctggtcgctgaatgtcgatgccagcacctgcggcacgtcaatgcttccgggcgtcgcgctcgggctgatcgcccatcccgttactgccccgatcccggcaatggcaaggactgccagcgctgccatttttggggtgaggccgttcgcggccgaggggcgcagcccctggggggatgggaggcccgcgttagcgggccgggagggttcgagaagggggggcaccccccttcggcgtgcgcggtcacgcgcacagggcgcagccctggttaaaaacaaggtttataaatattggtttaaaagcaggttaaaagacaggttagcggtggccgaaaaacgggcggaaacccttgcaaatgctggattttctgcctgtggacagcccctcaaatgtcaataggtgcgcccctcatctgtcagcactctgcccctcaagtgtcaaggatcgcgcccctcatctgtcagtagtcgcgcccctcaagtgtcaataccgcagggcacttatccccaggcttgtccacatcatctgtgggaaactcgcgtaaaatcaggcgttttcgccgatttgcgaggctggccagctccacgtcgccggccgaaatcgagcctgcccctcatctgtcaacgccgcgccgggtgagtcggcccctcaagtgtcaacgtccgcccctcatctgtcagtgagggccaagttttccgcgaggtatccacaacgccggcggccgcggtgtctcgcacacggcttcgacggcgtttctggcgcgtttgcagggccatagacggccgccagcccagcggcgagggcaaccagcccggtgagcgtcggaaaggcgctcggtcttgccttgctcgtcggtgatgtacttcaccagctccgcgaagtcgctcttcttgatggagcgcatggggacgtgcttggcaatcacgcgcaccccccggccgttttagcggctaaaaaagtcatggctctgccctcgggcggaccacgcccatcatgaccttgccaagctcgtcctgcttctcttcgatcttcgccagcagggcgaggatcgtggcatcaccgaaccgcgccgtgcgcgggtcgtcggtgagccagagtttcagcaggccgcccaggcggcccaggtcgccattgatgcgggccagctcgcggacgtgctcatagtccacgacgcccgtgattttgtagccctggccgacggccagcaggtaggccgacaggctcatgccggccgccgccgccttttcctcaatcgctcttcgttcgtctggaaggcagtacaccttgataggtgggctgcccttcctggttggcttggtttcatcagccatccgcttgccctcatctgttacgccggcggtagccggccagcctcgcagagcaggattcccgttgagcaccgccaggtgcgaataagggacagtgaagaaggaacacccgctcgcgggtgggcctacttcacctatcctgcccggctgacgccgttggatacaccaaggaaagtctacacgaaccctttggcaaaatcctgtatatcgtgcgaaaaaggatggatataccgaaaaaatcgctataatgaccccgaagcagggttatgcagcggaaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgccagaaggccgccagagaggccgagcgcggccgtgaggcttggacgctagggcagggcatgaaaaagcccgtagcgggctgctacgggcgtctgacgcggtggaaagggggaggggatgttgtctacatggctctgctgtagtgagtgggttgcgctccggcagcggtcctgatcaatcgtcaccctttctcggtccttcaacgttcctgacaacgagcctccttttcgccaatccatcgacaatcaccgcgagtccctgctcgaacgctgcgtccggaccggcttcgtcgaaggcgtctatcgcggcccgcaacagcggcgagagcggagcctgttcaacggtgccgccgcgctcgccggcatcgctgtcgccggcctgctcctcaagcacggccccaacagtgaagtagctgattgtcatcagcgcattgacggcgtccccggccgaaaaacccgcctcgcagaggaagcgaagctgcgcgtcggccgtttccatctgcggtgcgcccggtcgcgtgccggcatggatgcgcgcgccatcgcggtaggcgagcagcgcctgcctgaagctgcgggcattcccgatcagaaatgagcgccagtcgtcgtcggctctcggcaccgaatgcgtatgattctccgccagcatggcttcggccagtgcgtcgagcagcgcccgcttgttcctgaagtgccagtaaagcgccggctgctgaacccccaaccgttccgccagtttgcgtgtcgtcagaccgtctacgccgacctcgttcaacaggtccagggcggcacggatcactgtattcggctgcaactttgtcatgcttgacactttatcactgataaacataatatgtccaccaacttatcagtgataaagaatccgcgcgttcaatcggaccagcggaggctggtccggaggccagacgtgaaacccaacatacccctgatcgtaattctgagcactgtcgcgctcgacgctgtcggcatcggcctgattatgccggtgctgccgggcctcctgcgcgatctggttcactcgaacgacgtcaccgcccactatggcattctgctggcgctgtatgcgttggtgcaatttgcctgcgcacctgtgctgggcgcgctgtcggatcgtttcgggcggcggccaatcttgctcgtctcgctggccggcgccagatctggggaaccctgtggttggcatgcacatacaaatggacgaacggataaaccttttcacgcccttttaaatatccgattattctaataaacgctcttttctcttaggtttacccgccaatatatcctgtcaaacactgatagtttaaactgaaggcgggaaacgacaatctgatctctaggaagcttgcatgcctgcaggtcaacatggtggagcacgacacacttgtctactccaaaaatatcaaagatacagtctcagaagaccaaagggcaattgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgataacatggtggagcacgacacacttgtctactccaaaaatatcaaagatacagtctcagaagaccaaagggcaattgagacttttcaacaaagggtaatatccggaaacctcctcggattccattgcccagctatctgtcactttattgtgaagatagtggaaaaggaaggtggctcttacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagaggacctcgagtatttttacaacaattaccaacaacaacaaacaacaaacaacattacaattactatttacaattacacatatgatgatgtcatgtcggaatatagacttgggtacgagtgttcttgatcattcttgtagctcttcttcaacaagtcgtcgattcttgtttggcaattcttcgaagaccgtttgtatgattggtggcagaagctgtgttggaaatttggtatttctccggcgagatttggctacttgcagagctgttccggctaaatccaaggagaattctctggtcaacggtattggtcaagatcaaacagtgatgctcaatctgaggcaagagtcacgaaagccaatatctttggaaactctgtttgaggtcgtagctgatgatttgcagaggttgaacgacaatcttttatcgattgttggtgcagaaaatccggttttgatatctgctgctgagcaaatcttcagcgctggtggcaagaggatgagaccgggtttggtattccttgtatcacgagccactgcggaattagcaggcttaaaggaacttacagtagaacatcggcgtttaggtgagatcattgagatgattcacaccgcaagtttgatacacgatgatgtgttagacgaaagtgatatgcgaagaggaagggaaacggttcacgagctattcggaacaagagtagctgtattagctggggatttcatgtttgctcaagcatcatggtacttagcaaatctcgaaaaccttgaagtcattaagctcataagtcaggtgatcaaagatttagcaagcggtgagataaagcaagcatcgagtttattcgattgtgatgtcaagcttgatgactacatgctaaagagttactacaagacagcttcattagtagctgcaagcaccaaaggagcagcaattttcagtaaagtcgaaagcaaggtcgcagagcaaatgtatcagttcgggaagaatctcggtttatcttttcaagtagttgatgacattctggacttcactcagtccacagagcagttaggtaagcctgcagctaatgacctagccaaaggtaacataacggcgccagtgatcttcgcgctagagaatgagccaaggctaagagagatcattgagtctgagttttgtgagcctggatcgcttgaagaagcgattgaaatagttagaaatcgcggtgggatcaagaaagctcaagaattagcaaaggagaaagctgaacttgcgttaaagaatttgaattgtcttcctaggagtggtttcagatcggctcttgaggatatggtaatgtttaatcttgaaaggattgattagggtac

SEQ ID NO: 20 - DNA, 1221 bp, Arabidopsis thaliana 	;
atgatgacgtcatgtcggaatatagatttaggtacgatgatgatggcatgtggttgtggccgtcgtcagtttccttcattagcgaagactgtttgtaagtttactagcagcaatagaagctatggcggtctggtggggagttgcaaagcggtgccaacgaaatcaaaggagatctctttgctcaatggtattggtcaatctcaaacagtgagttttgatttgaaacaagagtcaaaacagcctatttcgttggtgactctgtttgagctagtagctgttgatctgcagactttgaatgacaatcttttatcgattgttggtgcggaaaatccggttttgatatctgcggctgagcagattttcggagctggtggtaaaagaatgagaccgggtttggtattccttgtatcacatgccacggcggaattagcaggcctaaaggaactaacaacagaacaccggcgtttggctgagatcatcgagatgatacacactgcaagcttgatacacgacgatgtgttagacgagagtgacatgcgaagaggaaaggaaacagttcatgagcttttcggcacaagagtagcggtgctagctggagatttcatgtttgctcaagcgtcatggtacttagcaaatctcgagaatcttgaagttattaagctcatcagtcaggtgatcaaagactttgcaagcggagagataaagcaggcgtccagcttatttgactgcgacaccaagctcgacgagtacttactcaaaagtttctacaagacagcctctttagtggctgcgagcaccaaaggagctgccattttcagcagagttgagcctgatgtgacagaacaaatgtacgagtttgggaagaatctcggtctctctttccagatagttgatgatattttggatttcactcagtcgacagagcagctcgggaagccagcagggagtgatttggctaaaggtaacttaacagcacctgtgattttcgctctggagagggagccaaggctaagagagatcattgagtcagagttttgtgaggcgggttctctggaagaagcgattgaagcggtgacaaaaggtggggggattaagagagcacaagaattggctagggagaaagctgatgacgctataaagaatctacagtgtctacctcgaagtggcttcaggtcggctctagaagatatggtgttgtataacctcgaaagaattgattag

SEQ ID NO: 21 - DNA, 1254 bp, Arabidopsis thaliana 	;
atgatgatgtcatgtcggaatatagacttgggtacgagtgttcttgatcattcttgtagctcttcttcaacaagtcgtcgattcttgtttggcaattcttcgaagaccgtttgtatgattggtggcagaagctgtgttggaaatttggtatttctccggcgagatttggctacttgcagagctgttccggctaaatccaaggagaattctctggtcaacggtattggtcaagatcaaacagtgatgctcaatctgaggcaagagtcacgaaagccaatatctttggaaactctgtttgaggtcgtagctgatgatttgcagaggttgaacgacaatcttttatcgattgttggtgcagaaaatccggttttgatatctgctgctgagcaaatcttcagcgctggtggcaagaggatgagaccgggtttggtattccttgtatcacgagccactgcggaattagcaggcttaaaggaacttacagtagaacatcggcgtttaggtgagatcattgagatgattcacaccgcaagtttgatacacgatgatgtgttagacgaaagtgatatgcgaagaggaagggaaacggttcacgagctattcggaacaagagtagctgtattagctggggatttcatgtttgctcaagcatcatggtacttagcaaatctcgaaaaccttgaagtcattaagctcataagtcaggtgatcaaagattttgcaagcggtgagataaagcaagcatcgagtttattcgattgtgatgtcaagcttgatgactacatgctaaagagttactacaagacagcttcattagtagctgcaagcaccaaaggagcagcaattttcagtaaagtcgaaagcaaggtcgcagagcaaatgtatcagttcgggaagaatctcggtttatcttttcaagtagttgatgacattctggacttcactcagtccacagagcagttaggtaagcctgcagctaatgacctagccaaaggtaacataacggcgccagtgatcttcgcgctagagaatgagccaaggctaagagagatcattgagtctgagttttgtgagcctggatcgcttgaagaagcgattgaaatagttagaaatcgcggtgggatcaagaaagctcaagaattagcaaaggagaaagctgaacttgcgttaaagaatttgaattgtcttcctaggagtggtttcagatcggctcttgaggatatggtaatgtttaatcttgaaaggattgattag

SEQ ID NO: 22 - DNA, 1254 bp, Artificial Sequence; 		;
  Artificial SDPS
atgatgatgtcatgtcggaatatagacttgggtacgagtgttcttgatcattcttgtagctcttcttcaacaagtcgtcgattcttgtttggcaattcttcgaagaccgtttgtatgattggtggcagaagctgtgttggaaatttggtatttctccggcgagatttggctacttgcagagctgttccggctaaatccaaggagaattctctggtcaacggtattggtcaagatcaaacagtgatgctcaatctgaggcaagagtcacgaaagccaatatctttggaaactctgtttgaggtcgtagctgatgatttgcagaggttgaacgacaatcttttatcgattgttggtgcagaaaatccggttttgatatctgctgctgagcaaatcttcagcgctggtggcaagaggatgagaccgggtttggtattccttgtatcacgagccactgcggaattagcaggcttaaaggaacttacagtagaacatcggcgtttaggtgagatcattgagatgattcacaccgcaagtttgatacacgatgatgtgttagacgaaagtgatatgcgaagaggaagggaaacggttcacgagctattcggaacaagagtagctgtattagctggggatttcatgtttgctcaagcatcatggtacttagcaaatctcgaaaaccttgaagtcattaagctcataagtcaggtgatcaaagatttagcaagcggtgagataaagcaagcatcgagtttattcgattgtgatgtcaagcttgatgactacatgctaaagagttactacaagacagcttcattagtagctgcaagcaccaaaggagcagcaattttcagtaaagtcgaaagcaaggtcgcagagcaaatgtatcagttcgggaagaatctcggtttatcttttcaagtagttgatgacattctggacttcactcagtccacagagcagttaggtaagcctgcagctaatgacctagccaaaggtaacataacggcgccagtgatcttcgcgctagagaatgagccaaggctaagagagatcattgagtctgagttttgtgagcctggatcgcttgaagaagcgattgaaatagttagaaatcgcggtgggatcaagaaagctcaagaattagcaaaggagaaagctgaacttgcgttaaagaatttgaattgtcttcctaggagtggtttcagatcggctcttgaggatatggtaatgtttaatcttgaaaggattgattag

SEQ ID NO: 23 - DNA, 1224 bp, Zea mays 	;
atgttgtctctgagctgcagctgcccaggggtgtcgtccatgagcaagacggcgctcgattgggggcacctggtggcctcctgccgcagccgctggcacggcgcgcgggcgccgcccagacggcggcgcacgccatgtgtttgcttggttgccttaccgaccactacccagcctggccctgctgctgttgatgtgccctcacggacggttcctgctgtcacaacatcaagcgcccctgaacgcatttctgtttctgcgctgctcgaggttgtctcagacgacttgctcaacctcaacaacaatctcaaatcgcttgttggtgcagaaaatccagttttagtttctgcagcagaacaaattttcagtgctggtggaaagaggttaagaccagcattagtttttctggtatcgagagcaactgctgaattagctgctttgccggagctaactacagaacatcggcgcttggctgagatcatagagatgattcatactgcaagtctaatacatgatgatgtcatagacgatagcgggatgcgaagagggaaagaaacaatccaccagctgtacggcacacgggtggctgtgctcgctggcgattttatgttcgcgcagtcttcttggttcctagcaaacctagaaaacattgaagtcatcaagctcatcagccaggtaattaaggatttcgcgagcggcgagataaagcaagcgtcgacgcttttcgactgcgacgtgaccctggacgactatctgctgaagagctactacaagacggcctccctgatcgcggcgagcacgaggtccgcggccatcttcagcggcgtgggcagcggcgtgtgcgagcagatgtacgagtacgggcggaacctgggtctggcgttccaggtggtggacgacatcctggacctgacgcagtcggcggagcagctcgggaagccggcggcggggagcgaccttgccaagggcaacctgacggcgcccgtgatcctggcgctgcgggaggagccccggctgcggggcatcatcgagtccgagttctgcgagcccgggtccctggcggccgcggtggagctcgtgcacaggggcggcgggatccggagcgcgcgggagctcgcggaggagaaaggcggcctggcgttgcgcagcctgcagtgcctcccgaggagcgagttccggagcgctctcgagcgggtggtgcactacaatctccagcgggttcggtag

SEQ ID NO: 24 - DNA, 1275 bp, Zea mays 	;
atggcggcggcgccgtcctccctcgcctcctcgtcgcatatcccccgccgcgccacagccacggccccagcacagtcgcactcgcctccgttgccgcagcagctccgccccgccaggtccttcaaacgcggggcgctcgcgcagcacgtccggtacagctttgccggcagggaggcatcgaggcggcgcacaccaggtgcttgcttcgtggtctcatccagccagccaggccttgctgccatcgatgtgccggcagcgactattcctgatgccacgacgacaagcgtcactgagcggacttcggtttcatctcttttagaggttgtatcggaggacttgctcagccttaacaacaatctgaaatcgcttgttggtgcagaaaatccagttttggtttctgcagctgaacaaatttttggtgctggtggaaaaagattaaggccagcattggttttcctggtgtctagagcaactgctgaattagctggtttgtcggagttaactgcagaacatcgacggttggcagagataatcgagatgattcacactgcgagtttaatacatgatgatgtcatagatgatagtgggatgagaagagggaaggaaactattcaccaactatatggtacacgtgtggctgtacttgctggtgattttatgtttgcacaatcttcttggtttcttgcaaacctagaaaatattgaagttataaaattgatcagtcaggtcatcaaggactttgcaagcggcgagataaaacaagcttccactctttttgattgtgacatcacacttgacgactaccttctcaagagctactacaagactgcatctttgattgcagccagcacaaaatcagcttccatattcagtggcgtcagcaccactatttgtgaaaaaatgtatgcatatggcaggaatcttggtctatccttccaggttgtcgatgacatcctggatttcacccagtcagccgaacaacttggcaaaccagcagcaagtgacttggcaaagggaaacctgactgctccagtcatcttcgctttgcaaagtgaaccagagctaagggagatcattgattctgagttcagtgacacggattcgttagctactgcaatagagctcgttcatagaagtggtgggatacggagggcacatgagcttgcaagagagaagggtgacttggcaatccaaaatctgcagtgccttccaagaagtgacttcagaagtgcccttgagaagatggtggaatacaatcttgagaggattgagtag

SEQ ID NO: 25 - DNA, 1209 bp, Triticum aestivum 	;
atgctgtctgtgagctcgccgagggtgcacatgagccggaacgtcgtggatttgggcctgctggccgcctgccgctgccgccgctgggccgcgcgcccggcgcccaggcggcgcgcgccatgtgtttgtttcgtggccgcacccagccagacaggtcttgcggcgatcgacgtgccggcggcagagaccattgccagcgcggcggccgggacggcgaggctccccgagcgcgtgtccatcgcttcgctcttggatgtcgtctcggatgacctgctcaagctcaacaacaacctcaaatcgcttattggtgcagaaaacccagttttagtatctgccgcagaacaaatttttggtgctggtggaaagagattaagaccagcattggttttcctggtgtccagagcaacagcagaagtagctggcttgtcggagctaactacagaacataaacgtttggctgagatcatagaaatgattcacactgcgagtttaatacatgatgatgtcatagatgatagtgggatgcgcagagggaaagaaaccattcatcagctatatggaacacggatagcggtgcttgctggtgattttatgtttgcacaatcttcttggtttctggcaaacttggaaaacattgaggttataaagctcatcagccaggtgatcaaggactttgctagtggtgagattaaacagcagtcgacccttttcgactgcgacgtcaccctggacgactacctgctcaagagctactacaagactgcctccctgctcgcttcaagcacgaggtctgcggccatattcagcggggtgagcaccgccgtatgcgagcagatgtacgagtacggcaggaacctggggctgtcgttccaggtggtggacgacatcctcgacttcacgcagtcggcggagcagctgggcaagccggcggggagcgacctggccaaggggaacctgacggccccggtcatcttcgcgctgcaggagtcgccagagctgagggagatcatcgactcggagttctgcgacacgggctcgctgtcggcggccatggagctggtgcacaggagcggcggtatccggcgggcgcaggagctggccaaggagaagggcgacctggcgctccagaacctgcagtgcctccccaggagccatttcaggactgcacttgagaacatggtgaagtacaaccttgagaggatcgactag

SEQ ID NO: 26 - DNA, 1185 bp, Hordeum vulgare 	;
atgctgtctgtgagctccccgaggatgcacatgagccggaacgtggtggatttgggcctgctggccgcctgccgctgccgccgctgggccgcgcgcccggcgcccaggcggcgcgcgccatgtgtttgtttcgtggccgcacccagccagacaggtctcgcggcgatcgacgtgccggcggccgggacggcgaggctccccgagcgcgtgtccatcgcttcgctcttggacgtcgtctccgacgacctgctcaagctcaacaacaacctgaaatcgcttattggtgcagaaaatccagttttagtttctgccgcagaacaaatttttggtgctggtggaaagagattaagaccggcattggtttttctggtgtccagagcgacagcggaagtagctggcttatcggagctaactacagaacataaacgcttggcagagatcatagaaatgattcacactgcgagtttaatacatgatgatgtcatagatgatagtgggatgcgcagagggaaagaaaccatccatcagctatatggaacacggatagcggtgcttgctggtgatttcatgtttgcacaatcttcttggtttctggcaaacttagagaacatcgaagttataaagctcatcagccaggtgattaaggactttgctagtggggagataaaacagcaatcaacccttttcgactgcgacgtcaccctggacgactacctgctcaagagctactacaagactgcatccctgctggcgtcgagcacgaggtccgcggccatattcagcggggtgagcaccacggtgtgtgagcagatgtacgagtacggcaggaacctggggctgtcgttccaggtggtggacgacatcctcgacttcacccagtcggcagagcagctgggcaagccggcggggagcgacctggccaaggggaacctgacggcgccggtcatcttcgcgctgcaggagtcgccggagctgagggagatcatcgactcggagttctgcgacactggctcgctgtcggcggccatggagctggtacacaaaagcggcgggatacggagggcgcaggagctggccaaggagaagggcgacctggccctccagaacctgcagtgcctccccaggagccatttcaggaccgcccttgagaacatggtgacgtataatcttgagaggatcgactag

SEQ ID NO: 27 - DNA, 1272 bp, Glycine Max 	;
atgatgtctgtcacaggcaaaggcattgattttgctggcaaaaacttggtctctggctgctcttcaaatgcttcgtttgattggtacactgtgaggaactatgccaaggcgaatagtaataattctaatgggtgtggcagaggccatggacgtaaattggtttgttgtaagaggaggagcactcaatgtcgggtttcttctatgaagactgcacagcctactgtgaatggggggactcatgcaattgaaggccttaccacaggattggacttgaagggttattcagaagcccccatttccccagctaggttttttgaagcggttgccgatgatttgctaactctcaataaaaatcttcagtcgattgttggagcagaaaatcctgttttgatgtctgcagctgagcagatttttagtgctggtgggaagaggatgagaccagctctggtgttcttggtgtcaagggcgactgcagagttacttggcttgaaggaacttactgtaaagcatcgacgtttagcagagataattgaaatgattcatactgcaagcttgatacatgatgatgtactagatgagagtgaccttcgacgagggaagaaaactgttcatcaaatgtttggaacaagagttgcagtgctggctggagacttcatgtttgcacagtcatcatggtatctagccaaccttgaaaatattgaagtcattaaacttatcagccaggtgatcaaagattttgcaagtggggaaataaagcaggcttcgagcttgtttgattgtgatgtacaacttgatgagtatctaattaagagctattacaagacagcgtcgttgattgctgccagcacaaaaggagctgcgatctttagtggttctgacagcagtgtcactgagaaaatgtatgaatatggaaagaatcttggtctatcctttcaagttgtggatgacatattggatttcacgcaatcagcggagcaactgggaaagcctgctggcagtgaccttgccaagggcaacctgactgcaccagtgatttttgcactggagaaagaaccaaaattgagggatatcattgagtctgaattcagtgaggttggttcgcttgacgaggccatcaatttggtcaagagttgtgggggcattgaaagagcacaagagttagcaaaagagaaagctgatcttgcaattcaaagtctccaatgcctacctcagagtgtgtttcgtttagcccttgaggatatggtggcatataaccttcaacggattgcataa

SEQ ID NO: 28 - DNA, 1212 bp, Oryza sativa 	;
atgttgtctgtgagctgcccgagagtgtacatgagcaggaaggcgctggatttcggtcagctggcctcctgccggtgccgttgggctggccggtccggcatgcgggtggcgccgaggcggcgcatgccatgtgtttgtttcgtggcctcaccgagccagccaggccttgctgcagttgatgtgccagcagaggcgatttctagtgcgagaacaacaacaatgatccctgagcgaatttctgtttcttcacttttggaggttgtctccgacgacctgctgaaactcaacaataatctgaaatcgcttgttggtgcagaaaatccagttttagtttctgcggcagaacaaattttcggtgctggtggaaaaaggttaagaccagcattagtttttctggtgtccagagcaactgctgaattagctggtttgttggagcttactacagagcatcaacgcctggcagagatcatagagatgattcacacagcaagtttaatacatgatgatgtcatagatgatagtggcatgaggagagggaaagaaactattcatcagctatatggaacacgggtggccgtacttgctggtgattttatgtttgcacaatcttcttggttcctagcgaacttagaaaacatcgaagttattaagctcatcagccaggtgatcaaggactttgccagtggtgagataaaacaagcatctactctttttgactgcgacgtcacccttgatgattacttgctcaagagctattataaaaccgcttcgttgctcgcctcaagcacaagatctgctgcaatattcagtggtgtaagcaccactatatgcgaacaaatgtatgaatacggcaggaatctcgggctctcgttccaggtagtagatgatattcttgactttacccaatcagctgagcaacttgggaaaccagcagggagtgacttagcaaagggaaacctgacagctccagtcatattcgctttgcaagatgaacccaaactaagggagataatcgattctgagttcagtgaaagtgattcattggctactgcaatcgacttggttcacagaagtggtggaataagaagggcgcaggagcttgcaaaggagaaaggtgacttggctctccaaaatttgcagtgccttcccaagagccagttcagaagtacccttgagaacgtggtgaaatataatcttcagaggattgactga

SEQ ID NO: 29 - DNA, 1215 bp, Chlorella fusca 	;
atgcagagctccgtgatgcaaagggctgccaacacaaccagccacacaaccttcacaatacgtacaagtccacgtgctccatgtagttgtattcatggtcaaatacatcatcagttcgctgtgcctagaacggcacaacccaactttgacagtgtgcgacctcgcgtgctcatcgcctcagaagccagcgtccagacagcacccagtccttcttatccagagaaagtccaaccagcagaccttatcacacagattatacatccagtcgcagcagacatgcagcagatgaaccacaatttgcgaaacattgtgggcgaaaggtccccaatgctcatggcagctgcagaccagatatttggcgctggcgggaagaagctccgacccatgattgtgttcctggtagcaagagcaacagcaaacctcgctggcatggatgacatcacagagcgacaccggcggctggctgaaatcattgagatgatccacacagccagcctggtgcatgatgatgtcctcgatgactgtgcagtcagaagaggcaagcagaccgtcaacacgctgtatggcacgagggtagcggtgctggctggggacttcctgtttgctcaggcatcatggctcatagcaaacctggagaacctggaggtcatcaagctcatctcaaaggtcatcgctgactttgccaacggggagatcagccaggccagcagcctgtttgataccgaagtaaccctgcagcagtacttggacaagtccttctacaagacagctagcctcattgcagccagctgccgcagcagcgctgtgtttagtggtatgggggaagaggagaaggaggcgatgtacaactacggcaagcatttgggtctagccttccaggtcgttgatgatatcctagatttcacgcaaacggccgagcagctcggcaagccgcagggtcaagacctagcgtctggaaacctcacagcacccgtcatcttcgccttgaaccactcgtcagagctcgaaagcatcatccagagcgagttcacagagcaagactccctgcagcgggcgcttgctttggtcaacagcgcaggcggcatccaagcggcacgagatctcgcagagtctgaggctgacttggcgcggcaggcgttgagttgtttgagagattgtccggcaaagcggagtctggagttgatggtggattacgttcttgagaggattcactag

SEQ ID NO: 30 - DNA, 1215 bp, Artificial Sequence; 		;
  Artificial SDPS
atgcagagctccgtgatgcaaagggctgccaacacaaccagccacacaaccttcacaatacgtacaagtccacgtgctccatgtagttgtattcatggtcaaatacatcatcagttcgctgtgcctagaacggcacaacccaactttgacagtgtgcgacctcgcgtgctcatcgcctcagaagccagcgtccagacagcacccagtccttcttatccagagaaagtccaaccagcagaccttatcacacagattatacatccagtcgcagcagacatgcagcagatgaaccacaatttgcgaaacattgtgggcgaaaggtccccaatgctcatggcagctgcagaccagatatttggcgctggcgggaagaagctccgacccatgattgtgttcctggtagcaagagcaacagcaaacctcgctggcatggatgacatcacagagcgacaccggcggctggctgaaatcattgagatgatccacacagccagcctggtgcatgatgatgtcctcgatgactgtgcagtcagaagaggcaagcagaccgtcaacacgctgtatggcacgagggtagcggtgctggctggggacttcctgtttgctcaggcatcatggctcatagcaaacctggagaacctggaggtcatcaagctcatctcaaaggtcatcgctgaccttgccaacggggagatcagccaggccagcagcctgtttgataccgaagtaaccctgcagcagtacttggacaagtccttctacaagacagctagcctcattgcagccagctgccgcagcagcgctgtgtttagtggtatgggggaagaggagaaggaggcgatgtacaactacggcaagcatttgggtctagccttccaggtcgttgatgatatcctagatttcacgcaaacggccgagcagctcggcaagccgcagggtcaagacctagcgtctggaaacctcacagcacccgtcatcttcgccttgaaccactcgtcagagctcgaaagcatcatccagagcgagttcacagagcaagactccctgcagcgggcgcttgctttggtcaacagcgcaggcggcatccaagcggcacgagatctcgcagagtctgaggctgacttggcgcggcaggcgttgagttgtttgagagattgtccggcaaagcggagtctggagttgatggtggattacgttcttgagaggattcactag

SEQ ID NO: 31 - DNA, 1185 bp, Chlamydomonas reinhardtii 	;
atgggcctatacaacgttaccatccctgagcggatgagcctccctgaaacggtcgggtgctcatcgcggtgcctgccgcgccctcagccccgtctactacgcgctggccgccagccggctcggccggtggttcgcacccgtgtgtacacgcccactcgcgccgaggagcagaccgcccttcggctggaggcgcagctcgcgcccgcgaacctgctcagcgaaatcctggcgcctgtgacagcggatatgcagcaaatgaacaccaacctgaagaacgtggtgggcaacaggcatccgatgctgatggcagcggcggagcagatctttggggccggtggaaagaagctccggccagtcatcgtctttctggtcgcacactgcacggcgcagcgcgagggcctaacagagctgaccgagaagcaccggcgacttgcggagattaccgagatgattcacaccgccagccttgtgcacgacgacgtgctcgacgagtgcgacatccggcgaggcaagcagaccatcaacagcatgtatggcacccgcgtggccgtgctggccggcgacttcctgttcgcccagtcctcgtggttcctcgccaacctggacaacctggaggtcatcaagctgatcagtcaagtgattgcggactttgccaacggcgagatcagccaggccgccagcctgtttgacaccgacatcactctggagcagtacctggacaagtcgttctacaagaccgcctcgctcatcgccgccagctgccgctccgccgccgtgttcagcgacagccctgtggaggtgaaggaggccatgtacgcctacggcaagcacctgggcctggcattccaggtggtggacgacatcctggacttcacgcaaaccagcgagcagctgggcaagccgcagggccaggaccttgccagcggtaacctcacggcgcccgtcatcttcgcgctgcgcaagtcgcccgagctgctggacatcatcagcagcgagttcgtggaggagggcagcctgcagcgcgcgctgcagctggtgaatgagacgggcggcatcgaggaggcgcggctgctggcgcggcagcaggcggacctggcgctgtcggcgctggagtgcctgcccgagggctcctcgcgccgctcgctacggttgatggtggactatgtcctcgaccgcatctactaa

SEQ ID NO: 32 - DNA, 1185 bp, Artificial Sequence; 		;
  Artificial SDPS
atgcaccaccaccaccaccacggcaattcttcgaagaccgtttgtatgattggtggcagaagctgtgttggaaatttggtatttctccggcgagatttggctacttgcagagctgttccggctaaatccaaggagaattctctggtcaacggtattggtcaagatcaaacagtgatgctcaatctgaggcaagagtcacgaaagccaatatctttggaaactctgtttgaggtcgtagctgatgatttgcagaggttgaacgacaatcttttatcgattgttggtgcagaaaatccggttttgatatctgctgctgagcaaatcttcagcgctggtggcaagaggatgagaccgggtttggtattccttgtatcacgagccactgcggaattagcaggcttaaaggaacttacagtagaacatcggcgtttaggtgagatcattgagatgattcacaccgcaagtttgatacacgatgatgtgttagacgaaagtgatatgcgaagaggaagggaaacggttcacgagctattcggaacaagagtagctgtattagctggggatttcatgtttgctcaagcatcatggtacttagcaaatctcgaaaaccttgaagtcattaagctcataagtcaggtgatcaaagattttgcaagcggtgagataaagcaagcatcgagtttattcgattgtgatgtcaagcttgatgactacatgctaaagagttactacaagacagcttcattagtagctgcaagcaccaaaggagcagcaattttcagtaaagtcgaaagcaaggtcgcagagcaaatgtatcagttcgggaagaatctcggtttatcttttcaagtagttgatgacattctggacttcactcagtccacagagcagttaggtaagcctgcagctaatgacctagccaaaggtaacataacggcgccagtgatcttcgcgctagagaatgagccaaggctaagagagatcattgagtctgagttttgtgagcctggatcgcttgaagaagcgattgaaatagttagaaatcgcggtgggatcaagaaagctcaagaattagcaaaggagaaagctgaacttgcgttaaagaatttgaattgtcttcctaggagtggtttcagatcggctcttgaggatatggtaatgtttaatcttgaaaggattgattaa

SEQ ID NO: 33 - DNA, 1185 bp, Artificial Sequence; 		;
  Artificial SDPS
atgcaccaccaccaccaccacggcaattcttcgaagaccgtttgtatgattggtggcagaagctgtgttggaaatttggtatttctccggcgagatttggctacttgcagagctgttccggctaaatccaaggagaattctctggtcaacggtattggtcaagatcaaacagtgatgctcaatctgaggcaagagtcacgaaagccaatatctttggaaactctgtttgaggtcgtagctgatgatttgcagaggttgaacgacaatcttttatcgattgttggtgcagaaaatccggttttgatatctgctgctgagcaaatcttcagcgctggtggcaagaggatgagaccgggtttggtattccttgtatcacgagccactgcggaattagcaggcttaaaggaacttacagtagaacatcggcgtttaggtgagatcattgagatgattcacaccgcaagtttgatacacgatgatgtgttagacgaaagtgatatgcgaagaggaagggaaacggttcacgagctattcggaacaagagtagctgtattagctggggatttcatgtttgctcaagcatcatggtacttagcaaatctcgaaaaccttgaagtcattaagctcataagtcaggtgatcaaagatttagcaagcggtgagataaagcaagcatcgagtttattcgattgtgatgtcaagcttgatgactacatgctaaagagttactacaagacagcttcattagtagctgcaagcaccaaaggagcagcaattttcagtaaagtcgaaagcaaggtcgcagagcaaatgtatcagttcgggaagaatctcggtttatcttttcaagtagttgatgacattctggacttcactcagtccacagagcagttaggtaagcctgcagctaatgacctagccaaaggtaacataacggcgccagtgatcttcgcgctagagaatgagccaaggctaagagagatcattgagtctgagttttgtgagcctggatcgcttgaagaagcgattgaaatagttagaaatcgcggtgggatcaagaaagctcaagaattagcaaaggagaaagctgaacttgcgttaaagaatttgaattgtcttcctaggagtggtttcagatcggctcttgaggatatggtaatgtttaatcttgaaaggattgattaa

SEQ ID NO: 34 - DNA, 1104 bp, Artificial Sequence; 		;
  Artificial SDPS
atgcatcatcatcaccatcactgtctggccgccagcccgacaacaacacagcccggtccggcagccgttgatgtgcctagtcgcaccgtgccggcagtgaccaccagcagtgcaccggagcgcattagcgtgagcgctttactggaagtggtgagcaatgatttactgaatttaaacaacaatctgaagtctttagttggcgccgaaaatccggtgctggttagcgccgccgaacaaatttttagtgccggcggtaaacgcttacgcccggcactggtgtttctggttagccgtgccaccgcagagctggcagcattaccggagctgaccaccgaacatcgtcgtctggccgagattatcgagatgatccacaccgcctctttaatccacgacgatgtgatcgatgatagcggtatgcgtcgcggtaaagaaaccattcaccagctgtacggcacccgcgttgccgttctggctggtgatttcatgttcgcccagagcagctggtttttagcaaatctggagaacatcgaagtgattaaactgatcagccaagttatcaaggactttgcaagcggcgagatcaaacaagctagcactttattcgattgcgatgtgactttagacgattatttactgaagagctactacaagaccgcatctttaatcgccgccagtacacgtagcgccgcaattttcagcggcgttggtagcggtgtgtgcgagcagatgtatgagtatggccgcaatctgggtctggcctttcaagttgtggatgacattctggatctgacacagagcgcagaacagctgggcaaaccggcagccggcagcgatctggcaaaaggcaatctgaccgcccccgttattttagcactgcgcgaagaaccgcgtttacgcggcattattgaaagcgagttttgcgagccgggcagcttagcagcagccgttgaactggttcatcgcggtggcggtattcgtagcgcccgcgaactggccgaggaaaaaggtggtttagcattacgcagcttacagtgtttaccgcgtagtgaatttcgtagcgcactggaacgcgtggtgcattacaatctgcagcgcgttcgctaa

SEQ ID NO: 35 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 36 - DNA, 1104 bp, Artificial Sequence; 		;
  Artificial SDPS
atgcatcatcatcaccatcactgtctggccgccagcccgacaacaacacagcccggtccggcagccgttgatgtgcctagtcgcaccgtgccggcagtgaccaccagcagtgcaccggagcgcattagcgtgagcgctttactggaagtggtgagcaatgatttactgaatttaaacaacaatctgaagtctttagttggcgccgaaaatccggtgctggttagcgccgccgaacaaatttttagtgccggcggtaaacgcttacgcccggcactggtgtttctggttagccgtgccaccgcagagctggcagcattaccggagctgaccaccgaacatcgtcgtctggccgagattatcgagatgatccacaccgcctctttaatccacgacgatgtgatcgatgatagcggtatgcgtcgcggtaaagaaaccattcaccagctgtacggcacccgcgttgccgttctggctggtgatttcatgttcgcccagagcagctggtttttagcaaatctggagaacatcgaagtgattaaactgatcagccaagttatcaaggacctggcaagcggcgagatcaaacaagctagcactttattcgattgcgatgtgactttagacgattatttactgaagagctactacaagaccgcatctttaatcgccgccagtacacgtagcgccgcaattttcagcggcgttggtagcggtgtgtgcgagcagatgtatgagtatggccgcaatctgggtctggcctttcaagttgtggatgacattctggatctgacacagagcgcagaacagctgggcaaaccggcagccggcagcgatctggcaaaaggcaatctgaccgcccccgttattttagcactgcgcgaagaaccgcgtttacgcggcattattgaaagcgagttttgcgagccgggcagcttagcagcagccgttgaactggttcatcgcggtggcggtattcgtagcgcccgcgaactggccgaggaaaaaggtggtttagcattacgcagcttacagtgtttaccgcgtagtgaatttcgtagcgcactggaacgcgtggtgcattacaatctgcagcgcgttcgctaa

SEQ ID NO: 37 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatcagccaagttattaaggatctggccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 38 - DNA, 1254 bp, Artificial Sequence; 		;; identical to SEQ ID NO: 21
  Artificial SDPS

SEQ ID NO: 39 - DNA, 1254 bp, Artificial Sequence; 		;; identical to SEQ ID NO: 22
  Artificial SDPS

SEQ ID NO: 40 - DNA, 1215 bp, Artificial Sequence; 		;
  Artificial SDPS
atgcaatcttctgttatgcaaagggctgctaacactacttctcacactacatttactattaggacatcacctagggcaccttgctcatgcatacacggtcagattcaccaccagtttgctgtgcctaggactgcacaaccaaacttcgactcagtgaggccaagggtgttgattgcttctgaggcttcagtgcagactgctccatctccttcatacccagaaaaggtgcagccagctgatttgattactcaaattattcatcctgtggctgctgatatgcagcagatgaaccataatttgaggaacattgtgggagagaggtcacctatgcttatggcagcagctgaccagattttcggtgctggtggaaagaagcttaggccaatgattgtgttcttggtggctagggctactgctaaccttgcaggtatggacgacattactgagaggcacaggaggttggctgagattattgagatgattcatactgcttcacttgtgcacgatgatgtgttggacgactgtgctgtgaggagaggaaagcagactgtgaacactctttacggtactagggtggcagtgttggctggtgacttcctttttgctcaagcttcatggttgattgctaatcttgagaatttggaagtgattaagcttatttctaaggttattgctgactttgctaatggagaaatttctcaggcttcatctttgtttgatactgaggttacacttcagcagtacttggacaagtctttttataaaactgcttctttgattgcagcatcttgcaggtcttctgctgtgttctcaggtatgggtgaggaggagaaggaagctatgtacaattacggtaaacaccttggtcttgcattccaggtggtggatgatatattggattttactcagactgcagagcagttgggaaagccacagggtcaggaccttgcatctggaaaccttactgctcctgttatttttgctcttaatcattcatctgaattggaatctattattcaatctgagtttacagagcaggattcacttcagagggcattggctcttgtgaactcagctggtggtattcaggctgcaagggatcttgcagaatctgaggctgacttggctaggcaggcactttcatgccttagggactgcccagctaagaggtcattggagcttatggtggactacgttcttgaaagaattcattaa

SEQ ID NO: 41 - DNA, 1215 bp, Artificial Sequence; 		;
  Artificial SDPS
atgcaatcttctgttatgcaaagggctgctaacactacttctcacactacatttactattaggacatcacctagggcaccttgctcatgcatacacggtcagattcaccaccagtttgctgtgcctaggactgcacaaccaaacttcgactcagtgaggccaagggtgttgattgcttctgaggcttcagtgcagactgctccatctccttcatacccagaaaaggtgcagccagctgatttgattactcaaattattcatcctgtggctgctgatatgcagcagatgaaccataatttgaggaacattgtgggagagaggtcacctatgcttatggcagcagctgaccagattttcggtgctggtggaaagaagcttaggccaatgattgtgttcttggtggctagggctactgctaaccttgcaggtatggacgacattactgagaggcacaggaggttggctgagattattgagatgattcatactgcttcacttgtgcacgatgatgtgttggacgactgtgctgtgaggagaggaaagcagactgtgaacactctttacggtactagggtggcagtgttggctggtgacttcctttttgctcaagcttcatggttgattgctaatcttgagaatttggaagtgattaagcttatttctaaggttattgctgacttggctaatggagaaatttctcaggcttcatctttgtttgatactgaggttacacttcagcagtacttggacaagtctttttataaaactgcttctttgattgcagcatcttgcaggtcttctgctgtgttctcaggtatgggtgaggaggagaaggaagctatgtacaattacggtaaacaccttggtcttgcattccaggtggtggatgatatattggattttactcagactgcagagcagttgggaaagccacagggtcaggaccttgcatctggaaaccttactgctcctgttatttttgctcttaatcattcatctgaattggaatctattattcaatctgagtttacagagcaggattcacttcagagggcattggctcttgtgaactcagctggtggtattcaggctgcaagggatcttgcagaatctgaggctgacttggctaggcaggcactttcatgccttagggactgcccagctaagaggtcattggagcttatggtggactacgttcttgaaagaattcattaa

SEQ ID NO: 42 - DNA, 17284 bp, Artificial Sequence;
  Plasmid
aaccctgtggttggcatgcacatacaaatggacgaacggataaaccttttcacgcccttttaaatatccgattattctaataaacgctcttttctcttaggtttacccgccaatatatcctgtcaaacactgatagtttaaactggcactagcctaacggtgttgactaactaggccgcttccctaattagctaaggtaccggcgcgccaccggtgagctcgggacccgaattcattatgtggtctaggtaggttctatatataagaaaacttgaaatgttctaaaaaaaaattcaagcccatgcatgattgaagcaaacggtatagcaacggtgttaacctgatctagtgatctcttgcaatccttaacggccacctaccgcaggtagcaaacggcgtccccctcctcgatatctccgcggcgacctctggctttttccgcggaattgcgcggtggggacggattccacgagaccgcgacgcaaccgcctctcgccgctgggccccacaccgctcggtgccgtagcctcacgggactctttctccctcctcccccgttataaattggcttcatcccctccttgcctcatccatccaaatcccagtccccaatcccatcccttcgtaggagaaattcatcgaagctaagcgaatcctcgcgatcctctcaaggtactgcgagttttcgatccccctctcgacccctcgtatgtttgtgtttgtcgtagcgtttgattaggtatgctttccctgtttgtgttcgtcgtagcgtttgattaggtatgctttccctgttcgtgttcatcgtagtgtttgattaggtcgtgtgaggcgatggcctgctcgcgtccttcgatctgtagtcgatttgcgggtcgtggtgtagatctgcgggctgtgatgaagttatttggtgtgatctgctcgcctgattctgcgggttggctcgagtagatatgatggttggaccggttggttcgtttaccgcgctagggttgggctgggatgatgttgcatgcgccgttgcgcgtgatcccgcagcaggacttgcgtttgattgccagatctcgttacgattatgtgatttggtttggactttttagatctgtagcttctgcttatgtgccagatgcgcctactgctcatatgcctgatgataatcataaatggctgtggaactaactagttgattgcggagtcatgtatcagctacaggtgtagggactagctacaggtgtagggacttgcgtctaattgtttggtcctttactcatgttgcaattatgcaatttagtttagattgtttgttccactcatctaggctgtaaaagggacactgcttagattgctgtttaatctttttagtagattatattatattggtaacttattacccctattacatgccatacgtgacttctgctcatgcctgatgataatcatagatcactgtggaattaattagttgattgttgaatcatgtttcatgtacataccacggcacaattgcttagttccttaacaaatgcaaattttactgatccatgtatgatttgcgtggttctctaatgtgaaatactatagctacttgttagtaagaatcaggttcgtatgcttaatgctgtatgtgccttctgctcatgcctgatgataatcatatatcactggaattaattagttgatcgtttaatcatatatcaagtacataccatgccacaatttttagtcacttaacccatgcagattgaactggtccctgcatgttttgctaaattgttctattctgattagaccatatatcatgtatttttttttggtaatggttctcttattttaaatgctatatagttctggtacttgttagaaagatctgcttcatagtttagttgcctatccctcgaattaggatgctgagcagctgatcctatagctttgtttcatgtatcaattcttttgtgttcaacagtcagtttttgttagattcattgtaacttatggtcgcttactcttctggtcctcaatgcttgcagggatcccctaaatagaccatggctcctaagaagaagcggaaggttggtattcacggggtgcctgcggcttcaaagctcgagaaattcaccaactgttattcgttgagcaaaacactgcggtttaaagcgattccagtcggcaagactcaagagaatatagacaataagcggctgttggtggaagatgaaaagcgcgcggaagactacaaaggggtgaagaagttgttggacagatactacctctcttttatcaatgatgtcttgcactcaatcaaattgaagaatctgaacaactacatctccctcttcagaaagaaaacaaggacagaaaaggagaataaggaacttgaaaatttggagatcaatctgaggaaagagatcgcgaaagcctttaaaggcaacgaaggatacaaaagtctgttcaagaaggatataattgagacaattttgccagagttcctcgatgacaaggacgagattgcgctggtcaattcgttcaacggattcacaacagcattcacaggcttctttgataatcgggaaaatatgttctctgaggaggcaaagtccacttctattgcgttcaggtgtatcaatgagaatctcactaggtacatttccaacatggatatctttgagaaggttgacgcaatttttgacaagcacgaagttcaggagattaaggagaagatcctcaattccgattatgacgttgaggacttcttcgagggtgagttttttaatttcgtgctcactcaagagggtatcgacgtgtataatgcgatcatcggtgggttcgtgactgagtccggtgaaaagattaagggattgaacgagtatatcaacctttacaaccaaaagacgaaacagaagctgccaaagttcaagcctctttacaaacaggttctttcagaccgcgagtcactctcgttctatggggagggctacacttcggatgaggaagtcctggaggtgttcaggaatactctcaataagaattcggagattttctcttctataaaaaaactggaaaagttgtttaagaattttgacgaatactctagcgccggcatatttgtgaaaaacggcccggccatatcaacgataagtaaagatatcttcggcgaatggaacgtgatcagagacaaatggaacgcggagtatgacgatattcacctgaagaagaaggctgtcgtaacggagaagtacgaggatgatcgcaggaaaagcttcaaaaagatcggaagtttcagcctggaacagttgcaggagtatgctgacgccgatcttagcgtcgtcgagaagttgaaggagataatcatccaaaaggtcgacgagatatataaagtctatggatcaagtgaaaaactgttcgacgccgacttcgttttggagaagtccctgaagaagaacgacgctgttgttgccattatgaaggatctgctcgacagcgtgaagagtttcgagaactatattaaggcttttttcggggaggggaaggagactaacagagatgagtccttctacggagacttcgtcctcgcgtacgatatactccttaaggtagaccacatctacgacgcaatcagaaattacgtgacacaaaagccgtacagcaaggacaagttcaaactctacttccagaacccccagttcatgggcggctgggacaaggacaaggaaacggattacagggctacgatcctgaggtatggttcaaaatactacttggcgattatggacaagaagtacgccaagtgtctccagaagattgacaaagacgatgtcaatggcaattatgagaagatcaactacaagctgcttccgggtccgaacaagatgctcccaaaggttttcttcagcaagaaatggatggcctactataacccaagcgaggacatccagaagatttataagaacggtacgttcaagaagggcgacatgttcaatcttaacgactgtcacaagctgatcgacttcttcaaagactcaattagccggtacccaaagtggtctaacgcctatgacttcaacttttcggaaaccgagaagtacaaggatatagccggattttatagagaggtggaagagcagggctacaaggtgtcattcgagtccgccagcaagaaggaagtggacaagctcgtggaagagggtaagctctacatgttccagatttataataaagactttagcgataagagccacgggacacctaatctccacacaatgtatttcaagctgctcttcgacgagaataaccacggccaaatcaggttgtcaggaggggctgaactcttcatgcggcgcgctagccttaagaaggaggagcttgtagtccaccctgcgaatagtccaattgcgaataagaacccggacaatcctaaaaagactacaacattgagctacgacgtgtacaaggataagaggttttccgaggatcagtacgagctccacatcccgattgcgatcaacaagtgcccaaagaatattttcaagataaacacagaggtgcgtgtactcctgaagcatgacgacaatccttacgtcattgggattgatcggggcgagaggaacctcctctatattgtggtggtggacgggaaggggaacatagtcgaacagtactcccttaacgaaataattaacaatttcaacggcatccgtatcaagaccgactaccattcgttgctggacaagaaggagaaggagagatttgaggcgcggcaaaattggacaagtatcgagaacatcaaggaactcaaagcaggttatatctctcaagttgtgcataagatatgcgagctggttgagaagtatgacgcagtgatcgctcttgaggacctcaactcgggctttaagaattctagagttaaagtggagaagcaggtctatcaaaagttcgagaagatgcttatagataagctcaactacatggtcgataagaaatcgaacccatgtgccaccggcggcgcactcaaaggttaccaaataacaaacaaattcgagtccttcaaatcgatgagtactcagaatgggttcatattttatataccggcgtggcttacgtctaagatcgacccgtcaactggttttgtcaacctgttgaagacgaaatacacgtccattgccgattcaaaaaagttcatatctagttttgatcgtattatgtacgtcccagaggaagatcttttcgagtttgctctcgactacaaaaacttttcgcgcaccgatgcggattacattaaaaaatggaaactctattcgtacggcaacagaatcaggatttttcgcaaccctaagaagaataacgtctttgattgggaggaagtttgcttgactagcgcgtacaaggagctctttaataagtatggcattaactaccaacagggtgatatcagagcactgctttgcgaacaatctgacaaggctttctactcatccttcatggctttgatgagcctgatgctccagatgagaaattcaattacaggcagaaccgacgtggatttcttgatctccccggttaaaaattctgatggcatcttttacgatagcaggaactatgaagcgcaagagaatgcgattctgccaaaaaatgcagacgccaacggtgcctataacatcgccaggaaagtcctgtgggcgatcggccagttcaaaaaggccgaagacgaaaaattggacaaggtcaaaatcgctatcagcaacaaagagtggctggagtatgctcagacatccgtaaagcataagcgtcctgctgccaccaaaaaggccggacaggctaagaaaaagaagtgattaattaagatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcttcgaagaattcattatgtggtctaggtaggttctatatataagaaaacttgaaatgttctaaaaaaaaattcaagcccatgcatgattgaagcaaacggtatagcaacggtgttaacctgatctagtgatctcttgcaatccttaacggccacctaccgcaggtagcaaacggcgtccccctcctcgatatctccgcggcgacctctggctttttccgcggaattgcgcggtggggacggattccacgagaccgcgacgcaaccgcctctcgccgctgggccccacaccgctcggtgccgtagcctcacgggactctttctccctcctcccccgttataaattggcttcatcccctccttgcctcatccatccaaatcccagtccccaatcccatcccttcgtaggagaaattcatcgaagctaagcgaatcctcgcgatcctctcaaggtactgcgagttttcgatccccctctcgacccctcgtatgtttgtgtttgtcgtagcgtttgattaggtatgctttccctgtttgtgttcgtcgtagcgtttgattaggtatgctttccctgttcgtgttcatcgtagtgtttgattaggtcgtgtgaggcgatggcctgctcgcgtccttcgatctgtagtcgatttgcgggtcgtggtgtagatctgcgggctgtgatgaagttatttggtgtgatctgctcgcctgattctgcgggttggctcgagtagatatgatggttggaccggttggttcgtttaccgcgctagggttgggctgggatgatgttgcatgcgccgttgcgcgtgatcccgcagcaggacttgcgtttgattgccagatctcgttacgattatgtgatttggtttggactttttagatctgtagcttctgcttatgtgccagatgcgcctactgctcatatgcctgatgataatcataaatggctgtggaactaactagttgattgcggagtcatgtatcagctacaggtgtagggactagctacaggtgtagggacttgcgtctaattgtttggtcctttactcatgttgcaattatgcaatttagtttagattgtttgttccactcatctaggctgtaaaagggacactgcttagattgctgtttaatctttttagtagattatattatattggtaacttattacccctattacatgccatacgtgacttctgctcatgcctgatgataatcatagatcactgtggaattaattagttgattgttgaatcatgtttcatgtacataccacggcacaattgcttagttccttaacaaatgcaaattttactgatccatgtatgatttgcgtggttctctaatgtgaaatactatagctacttgttagtaagaatcaggttcgtatgcttaatgctgtatgtgccttctgctcatgcctgatgataatcatatatcactggaattaattagttgatcgtttaatcatatatcaagtacataccatgccacaatttttagtcacttaacccatgcagattgaactggtccctgcatgttttgctaaattgttctattctgattagaccatatatcatgtatttttttttggtaatggttctcttattttaaatgctatatagttctggtacttgttagaaagatctgcttcatagtttagttgcctatccctcgaattaggatgctgagcagctgatcctatagctttgtttcatgtatcaattcttttgtgttcaacagtcagtttttgttagattcattgtaacttatggtcgcttactcttctggtcctcaatgcttgcaggggatccaaattactgatgagtccgtgaggacgaaacgagtaagctcgtctaatttctactaagtgtagatcaagcggcgagataaaacaagctggccggcatggtcccagcctcctcgctggcgccggctgggcaacatgcttcggcatggcgaatgggacgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatccggaccgcgcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcagggatccggcagcagccatgcagaagctgatcaacagcgtgcagaactacgcctggggcagcaagaccgccctgaccgagctgtacggcatggagaaccccagcagccagcccatggccgagctgtggatgggcgcccaccccaagagcagcagccgcgtgcagaacgccgccggcgacatcgtgagcctgcgcgacgtgatcgagagcgacaagagcaccctgctgggcgaggccgtggccaagcgcttcggcgagctgcccttcctgttcaaggtgctgtgcgccgcccagcccctgagcatccaggtgcaccccaacaagcacaacagcgagatcggcttcgccaaggagaacgccgccggcatccccatggacgccgccgagcgcaactacaaggaccccaaccacaagcccgagctggtgttcgccctgacccccttcctggccatgaacgccttccgcgagttcagcgagatcgtgagcctgctgcagcccgtggccggcgcccaccccgccatcgcccacttcctgcagcagcccgacgccgagcgcctgagcgagctgttcgccagcctgctgaacatgcagggcgaggagaagagccgcgccctggccatcctgaagagcgccctggacagccagcagggcgagccctggcagaccatccgcctgatcagcgagttctaccccgaggacagcggcctgttcagccccctgctgctgaacgtggtgaagctgaaccccggcgaggccatgttcctgttcgccgagaccccccacgcctacctgcagggcgtggccctggaggtgatggccaacagcgacaacgtgctgcgcgccggcctgacccccaagtacatcgacatccccgagctggtggccaacgtgaagttcgaggccaagcccgccaaccagctgctgacccagcccgtgaagcagggcgccgagctggacttccccatccccgtggacgacttcgccttcagcctgcacgacctgagcgacaaggagaccaccatcagccagcagagcgccgccatcctgttctgcgtggagggcgacgccaccctgtggaagggcagccagcagctgcagctgaagcccggcgagagcgccttcatcgccgccaacgagagccccgtgaccgtgaagggccacggccgcctggcccgcgtgtacaacaagctgtgataggagctcgatccgtcgacctgcagatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcggcgcgccgcaattgaagtttgggcggccagcatggccgtatccgcaatgtgttattaagttgtctaagcgtcaatttgtttacaccacaatatatcctgccaccagccagccaacagctccccgaccggcagctcggcacaaaatcaccactcgatacaggcagcccatcagaattaattctcatgtttgacagcttatcatcgactgcacggtgcaccaatgcttctggcgtcaggcagccatcggaagctgtggtatggctgtgcaggtcgtaaatcactgcataattcgtgtcgctcaaggcgcactcccgttctggataatgttttttgcgccgacatcataacggttctggcaaatattctgaaatgagctgttgacaattaatcatccggctcgtataatgtgtggaattgtgagcggataacaatttcacacaggaaacagaccatgagggaagcgttgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaagtagtcggcaaataaagctctagtggatctccgtacccggggatctggctcgcggcggacgcacgacgccggggcgagaccataggcgatctcctaaatcaatagtagctgtaacctcgaagcgtttcacttgtaacaacgattgagaatttttgtcataaaattgaaatacttggttcgcatttttgtcatccgcggtcagccgcaattctgacgaactgcccatttagctggagatgattgtacatccttcacgtgaaaatttctcaagcgctgtgaacaagggttcagattttagattgaaaggtgagccgttgaaacacgttcttcttgtcgatgacgacgtcgctatgcggcatcttattattgaataccttacgatccacgccttcaaagtgaccgcggtagccgacagcacccagttcacaagagtactctcttccgcgacggtcgatgtcgtggttgttgatctagatttaggtcgtgaagatgggctcgagctaggagcaagtgattttatcgctaagccgttcagtatcagagagtttctagcacgcattcgggttgccttgcgcgtgcgccccaacgttgtccgctccaaagaccgacggtctttttgttttactgactggacacttaatctcaggcaacgtcgcttgatgtccgaagctggcggtgaggtgaaacttacggcaggtgagttcaatcttctcctcgcgtttttagagaaaccccgcgacgttctatcgcgcgagcaacttctcattgccagtcgagtacgcgacgaggaggtttatgacaggagtatagatgttctcattttgaggctgcgccgcaaacttgaggcagatccgtcaagccctcaactgataaaaacagcaagaggtgccggttatttctttgacgcggacgtgcaggtttcgcacggggggacgatggcagcctgagccaattcccagatccccgaggaatcggcgtgagcggtcgcaaaccatccggcccggtacaaatcggcgcggcgctgggtgatgacctggtggagaagttgaaggccgcgcaggccgcccagcggcaacgcatcgaggcagaagcacgccccggtgaatcgtggcaagcggccgctgatcgaatccgcaaagaatcccggcaaccgccggcagccggtgcgccgtcgattaggaagccgcccaagggcgacgagcaaccagattttttcgttccgatgctctatgacgtgggcacccgcgatagtcgcagcatcatggacgtggccgttttccgtctgtcgaagcgtgaccgacgagctggcgaggtgatccgctacgagcttccagacgggcacgtagaggtttccgcagggccggccggcatggccagtgtgtgggattacgacctggtactgatggcggtttcccatctaaccgaatccatgaaccgataccgggaagggaagggagacaagcccggccgcgtgttccgtccacacgttgcggacgtactcaagttctgccggcgagccgatggcggaaagcagaaagacgacctggtagaaacctgcattcggttaaacaccacgcacgttgccatgcagcgtacgaagaaggccaagaacggccgcctggtgacggtatccgagggtgaagccttgattagccgctacaagatcgtaaagagcgaaaccgggcggccggagtacatcgagatcgagctagctgattggatgtaccgcgagatcacagaaggcaagaacccggacgtgctgacggttcaccccgattactttttgatcgatcccggcatcggccgttttctctaccgcctggcacgccgcgccgcaggcaaggcagaagccagatggttgttcaagacgatctacgaacgcagtggcagcgccggagagttcaagaagttctgtttcaccgtgcgcaagctgatcgggtcaaatgacctgccggagtacgatttgaaggaggaggcggggcaggctggcccgatcctagtcatgcgctaccgcaacctgatcgagggcgaagcatccgccggttcctaatgtacggagcagatgctagggcaaattgccctagcaggggaaaaaggtcgaaaaggtctctttcctgtggatagcacgtacattgggaacccaaagccgtacattgggaaccggaacccgtacattgggaacccaaagccgtacattgggaaccggtcacacatgtaagtgactgatataaaagagaaaaaaggcgatttttccgcctaaaactctttaaaacttattaaaactcttaaaacccgcctggcctgtgcataactgtctggccagcgcacagccgaagagctgcaaaaagcgcctacccttcggtcgctgcgctccctacgccccgccgcttcgcgtcggcctatcgcggccgctggccgctcaaaaatggctggcctacggccaggcaatctaccagggcgcggacaagccgcgccgtcgccactcgaccgccggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagctctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttgatccggacaaacaaacaaatacagtaatttagccaggacgtcggccgaaagagcgacaagcagatcacgcttttcgacagcgtcggatttgcgatcgaggatttttcggcgctgcgctacgtccgcgaccgcgttgagggatcaagccacagcagcccactcgaccttctagccgacccagacgagccaagggatctttttggaatgctgctccgtcgtcaggctttccgacgtttgggtggttgaacagaagtcattatcgcacggaatgccaagcactcccgagggg

SEQ ID NO: 43 - DNA, 27 bp, Zea mays	;
tttgcaagcggcgagataaaacaagct

SEQ ID NO: 44 - DNA, 3783 bp, Artificial Sequence; 		;
  Cpf1
atggctcctaagaagaagcggaaggttggtattcacggggtgcctgcggcttcaaagctcgagaaattcaccaactgttattcgttgagcaaaacactgcggtttaaagcgattccagtcggcaagactcaagagaatatagacaataagcggctgttggtggaagatgaaaagcgcgcggaagactacaaaggggtgaagaagttgttggacagatactacctctcttttatcaatgatgtcttgcactcaatcaaattgaagaatctgaacaactacatctccctcttcagaaagaaaacaaggacagaaaaggagaataaggaacttgaaaatttggagatcaatctgaggaaagagatcgcgaaagcctttaaaggcaacgaaggatacaaaagtctgttcaagaaggatataattgagacaattttgccagagttcctcgatgacaaggacgagattgcgctggtcaattcgttcaacggattcacaacagcattcacaggcttctttgataatcgggaaaatatgttctctgaggaggcaaagtccacttctattgcgttcaggtgtatcaatgagaatctcactaggtacatttccaacatggatatctttgagaaggttgacgcaatttttgacaagcacgaagttcaggagattaaggagaagatcctcaattccgattatgacgttgaggacttcttcgagggtgagttttttaatttcgtgctcactcaagagggtatcgacgtgtataatgcgatcatcggtgggttcgtgactgagtccggtgaaaagattaagggattgaacgagtatatcaacctttacaaccaaaagacgaaacagaagctgccaaagttcaagcctctttacaaacaggttctttcagaccgcgagtcactctcgttctatggggagggctacacttcggatgaggaagtcctggaggtgttcaggaatactctcaataagaattcggagattttctcttctataaaaaaactggaaaagttgtttaagaattttgacgaatactctagcgccggcatatttgtgaaaaacggcccggccatatcaacgataagtaaagatatcttcggcgaatggaacgtgatcagagacaaatggaacgcggagtatgacgatattcacctgaagaagaaggctgtcgtaacggagaagtacgaggatgatcgcaggaaaagcttcaaaaagatcggaagtttcagcctggaacagttgcaggagtatgctgacgccgatcttagcgtcgtcgagaagttgaaggagataatcatccaaaaggtcgacgagatatataaagtctatggatcaagtgaaaaactgttcgacgccgacttcgttttggagaagtccctgaagaagaacgacgctgttgttgccattatgaaggatctgctcgacagcgtgaagagtttcgagaactatattaaggcttttttcggggaggggaaggagactaacagagatgagtccttctacggagacttcgtcctcgcgtacgatatactccttaaggtagaccacatctacgacgcaatcagaaattacgtgacacaaaagccgtacagcaaggacaagttcaaactctacttccagaacccccagttcatgggcggctgggacaaggacaaggaaacggattacagggctacgatcctgaggtatggttcaaaatactacttggcgattatggacaagaagtacgccaagtgtctccagaagattgacaaagacgatgtcaatggcaattatgagaagatcaactacaagctgcttccgggtccgaacaagatgctcccaaaggttttcttcagcaagaaatggatggcctactataacccaagcgaggacatccagaagatttataagaacggtacgttcaagaagggcgacatgttcaatcttaacgactgtcacaagctgatcgacttcttcaaagactcaattagccggtacccaaagtggtctaacgcctatgacttcaacttttcggaaaccgagaagtacaaggatatagccggattttatagagaggtggaagagcagggctacaaggtgtcattcgagtccgccagcaagaaggaagtggacaagctcgtggaagagggtaagctctacatgttccagatttataataaagactttagcgataagagccacgggacacctaatctccacacaatgtatttcaagctgctcttcgacgagaataaccacggccaaatcaggttgtcaggaggggctgaactcttcatgcggcgcgctagccttaagaaggaggagcttgtagtccaccctgcgaatagtccaattgcgaataagaacccggacaatcctaaaaagactacaacattgagctacgacgtgtacaaggataagaggttttccgaggatcagtacgagctccacatcccgattgcgatcaacaagtgcccaaagaatattttcaagataaacacagaggtgcgtgtactcctgaagcatgacgacaatccttacgtcattgggattgatcggggcgagaggaacctcctctatattgtggtggtggacgggaaggggaacatagtcgaacagtactcccttaacgaaataattaacaatttcaacggcatccgtatcaagaccgactaccattcgttgctggacaagaaggagaaggagagatttgaggcgcggcaaaattggacaagtatcgagaacatcaaggaactcaaagcaggttatatctctcaagttgtgcataagatatgcgagctggttgagaagtatgacgcagtgatcgctcttgaggacctcaactcgggctttaagaattctagagttaaagtggagaagcaggtctatcaaaagttcgagaagatgcttatagataagctcaactacatggtcgataagaaatcgaacccatgtgccaccggcggcgcactcaaaggttaccaaataacaaacaaattcgagtccttcaaatcgatgagtactcagaatgggttcatattttatataccggcgtggcttacgtctaagatcgacccgtcaactggttttgtcaacctgttgaagacgaaatacacgtccattgccgattcaaaaaagttcatatctagttttgatcgtattatgtacgtcccagaggaagatcttttcgagtttgctctcgactacaaaaacttttcgcgcaccgatgcggattacattaaaaaatggaaactctattcgtacggcaacagaatcaggatttttcgcaaccctaagaagaataacgtctttgattgggaggaagtttgcttgactagcgcgtacaaggagctctttaataagtatggcattaactaccaacagggtgatatcagagcactgctttgcgaacaatctgacaaggctttctactcatccttcatggctttgatgagcctgatgctccagatgagaaattcaattacaggcagaaccgacgtggatttcttgatctccccggttaaaaattctgatggcatcttttacgatagcaggaactatgaagcgcaagagaatgcgattctgccaaaaaatgcagacgccaacggtgcctataacatcgccaggaaagtcctgtgggcgatcggccagttcaaaaaggccgaagacgaaaaattggacaaggtcaaaatcgctatcagcaacaaagagtggctggagtatgctcagacatccgtaaagcataagcgtcctgctgccaccaaaaaggccggacaggctaagaaaaagaagtga

SEQ ID NO: 45 - protein, 347 aa, Artificial Sequence; 		;
  Artificial SDPS
MHHHHHHAATIPDATTTSVTERTSVSSLLEVVSEDLLSLNNNAKSLVGAENPVLVSAAEQIFGAGGKRLRPALVFLVSRATAELAGLSELTAEHRRLAEIIEMIHTASLIHDDVIDDSGMRRGKETIHQLYGTRVAVLAGDFMFAQSSWFLANLENIEVIKLISQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 46 - protein, 347 aa, Artificial Sequence; 		;
  Artificial SDPS
MHHHHHHAATIPDATTTSVTERTSVSSLLEVVSEDLLSLNNNRKSLVGAENPVLVSAAEQIFGAGGKRLRPALVFLVSRATAELAGLSELTAEHRRLAEIIEMIHTASLIHDDVIDDSGMRRGKETIHQLYGTRVAVLAGDFMFAQSSWFLANLENIEVIKLISQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 47 - protein, 347 aa, Artificial Sequence; 		;
  Artificial SDPS
MHHHHHHAATIPDATTTSVTERTSVSSLLEVVSEDLLSLNNNWKSLVGAENPVLVSAAEQIFGAGGKRLRPALVFLVSRATAELAGLSELTAEHRRLAEIIEMIHTASLIHDDVIDDSGMRRGKETIHQLYGTRVAVLAGDFMFAQSSWFLANLENIEVIKLISQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 48 - protein, 347 aa, Artificial Sequence; 		;
  Artificial SDPS
MHHHHHHAATIPDATTTSVTERTSVSSLLEVVSEDLLSLNNNLKSAVGAENPVLVSAAEQIFGAGGKRLRPALVFLVSRATAELAGLSELTAEHRRLAEIIEMIHTASLIHDDVIDDSGMRRGKETIHQLYGTRVAVLAGDFMFAQSSWFLANLENIEVIKLISQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 49 - protein, 347 aa, Artificial Sequence; 		;
  Artificial SDPS
MHHHHHHAATIPDATTTSVTERTSVSSLLEVVSEDLLSLNNNLKSCVGAENPVLVSAAEQIFGAGGKRLRPALVFLVSRATAELAGLSELTAEHRRLAEIIEMIHTASLIHDDVIDDSGMRRGKETIHQLYGTRVAVLAGDFMFAQSSWFLANLENIEVIKLISQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 50 - protein, 347 aa, Artificial Sequence; 		;
  Artificial SDPS
MHHHHHHAATIPDATTTSVTERTSVSSLLEVVSEDLLSLNNNLKSDVGAENPVLVSAAEQIFGAGGKRLRPALVFLVSRATAELAGLSELTAEHRRLAEIIEMIHTASLIHDDVIDDSGMRRGKETIHQLYGTRVAVLAGDFMFAQSSWFLANLENIEVIKLISQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 51 - protein, 347 aa, Artificial Sequence; 		;
  Artificial SDPS
MHHHHHHAATIPDATTTSVTERTSVSSLLEVVSEDLLSLNNNLKSNVGAENPVLVSAAEQIFGAGGKRLRPALVFLVSRATAELAGLSELTAEHRRLAEIIEMIHTASLIHDDVIDDSGMRRGKETIHQLYGTRVAVLAGDFMFAQSSWFLANLENIEVIKLISQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 52 - protein, 347 aa, Artificial Sequence; 		;
  Artificial SDPS
MHHHHHHAATIPDATTTSVTERTSVSSLLEVVSEDLLSLNNNLKSSVGAENPVLVSAAEQIFGAGGKRLRPALVFLVSRATAELAGLSELTAEHRRLAEIIEMIHTASLIHDDVIDDSGMRRGKETIHQLYGTRVAVLAGDFMFAQSSWFLANLENIEVIKLISQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 53 - protein, 347 aa, Artificial Sequence; 		;
  Artificial SDPS
MHHHHHHAATIPDATTTSVTERTSVSSLLEVVSEDLLSLNNNLKSWVGAENPVLVSAAEQIFGAGGKRLRPALVFLVSRATAELAGLSELTAEHRRLAEIIEMIHTASLIHDDVIDDSGMRRGKETIHQLYGTRVAVLAGDFMFAQSSWFLANLENIEVIKLISQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 54 - protein, 347 aa, Artificial Sequence; 		;
  Artificial SDPS
MHHHHHHAATIPDATTTSVTERTSVSSLLEVVSEDLLSLNNNLKSLVGAANPVLVSAAEQIFGAGGKRLRPALVFLVSRATAELAGLSELTAEHRRLAEIIEMIHTASLIHDDVIDDSGMRRGKETIHQLYGTRVAVLAGDFMFAQSSWFLANLENIEVIKLISQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 55 - protein, 347 aa, Artificial Sequence; 		;
  Artificial SDPS
MHHHHHHAATIPDATTTSVTERTSVSSLLEVVSEDLLSLNNNLKSLVGAGNPVLVSAAEQIFGAGGKRLRPALVFLVSRATAELAGLSELTAEHRRLAEIIEMIHTASLIHDDVIDDSGMRRGKETIHQLYGTRVAVLAGDFMFAQSSWFLANLENIEVIKLISQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 56 - protein, 347 aa, Artificial Sequence; 		;
  Artificial SDPS
MHHHHHHAATIPDATTTSVTERTSVSSLLEVVSEDLLSLNNNLKSLVGAKNPVLVSAAEQIFGAGGKRLRPALVFLVSRATAELAGLSELTAEHRRLAEIIEMIHTASLIHDDVIDDSGMRRGKETIHQLYGTRVAVLAGDFMFAQSSWFLANLENIEVIKLISQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 57 - protein, 347 aa, Artificial Sequence; 		;
  Artificial SDPS
MHHHHHHAATIPDATTTSVTERTSVSSLLEVVSEDLLSLNNNLKSLVGAYNPVLVSAAEQIFGAGGKRLRPALVFLVSRATAELAGLSELTAEHRRLAEIIEMIHTASLIHDDVIDDSGMRRGKETIHQLYGTRVAVLAGDFMFAQSSWFLANLENIEVIKLISQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 58 - protein, 347 aa, Artificial Sequence; 		;
  Artificial SDPS
MHHHHHHAATIPDATTTSVTERTSVSSLLEVVSEDLLSLNNNLKSLVGAELPVLVSAAEQIFGAGGKRLRPALVFLVSRATAELAGLSELTAEHRRLAEIIEMIHTASLIHDDVIDDSGMRRGKETIHQLYGTRVAVLAGDFMFAQSSWFLANLENIEVIKLISQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 59 - protein, 347 aa, Artificial Sequence; 		;
  Artificial SDPS
MHHHHHHAATIPDATTTSVTERTSVSSLLEVVSEDLLSLNNNLKSLVGAEPPVLVSAAEQIFGAGGKRLRPALVFLVSRATAELAGLSELTAEHRRLAEIIEMIHTASLIHDDVIDDSGMRRGKETIHQLYGTRVAVLAGDFMFAQSSWFLANLENIEVIKLISQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 60 - protein, 347 aa, Artificial Sequence; 		;
  Artificial SDPS
MHHHHHHAATIPDATTTSVTERTSVSSLLEVVSEDLLSLNNNLKSLVGAENPDLVSAAEQIFGAGGKRLRPALVFLVSRATAELAGLSELTAEHRRLAEIIEMIHTASLIHDDVIDDSGMRRGKETIHQLYGTRVAVLAGDFMFAQSSWFLANLENIEVIKLISQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 61 - protein, 347 aa, Artificial Sequence; 		;
  Artificial SDPS
MHHHHHHAATIPDATTTSVTERTSVSSLLEVVSEDLLSLNNNLKSLVGAENPKLVSAAEQIFGAGGKRLRPALVFLVSRATAELAGLSELTAEHRRLAEIIEMIHTASLIHDDVIDDSGMRRGKETIHQLYGTRVAVLAGDFMFAQSSWFLANLENIEVIKLISQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 62 - protein, 347 aa, Artificial Sequence; 		;
  Artificial SDPS
MHHHHHHAATIPDATTTSVTERTSVSSLLEVVSEDLLSLNNNLKSLVGAENPVAVSAAEQIFGAGGKRLRPALVFLVSRATAELAGLSELTAEHRRLAEIIEMIHTASLIHDDVIDDSGMRRGKETIHQLYGTRVAVLAGDFMFAQSSWFLANLENIEVIKLISQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 63 - protein, 347 aa, Artificial Sequence; 		;
  Artificial SDPS
MHHHHHHAATIPDATTTSVTERTSVSSLLEVVSEDLLSLNNNLKSLVGAENPVEVSAAEQIFGAGGKRLRPALVFLVSRATAELAGLSELTAEHRRLAEIIEMIHTASLIHDDVIDDSGMRRGKETIHQLYGTRVAVLAGDFMFAQSSWFLANLENIEVIKLISQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 64 - protein, 347 aa, Artificial Sequence; 		;
  Artificial SDPS
MHHHHHHAATIPDATTTSVTERTSVSSLLEVVSEDLLSLNNNLKSLVGAENPVMVSAAEQIFGAGGKRLRPALVFLVSRATAELAGLSELTAEHRRLAEIIEMIHTASLIHDDVIDDSGMRRGKETIHQLYGTRVAVLAGDFMFAQSSWFLANLENIEVIKLISQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 65 - protein, 347 aa, Artificial Sequence; 		;
  Artificial SDPS
MHHHHHHAATIPDATTTSVTERTSVSSLLEVVSEDLLSLNNNLKSLVGAENPVPVSAAEQIFGAGGKRLRPALVFLVSRATAELAGLSELTAEHRRLAEIIEMIHTASLIHDDVIDDSGMRRGKETIHQLYGTRVAVLAGDFMFAQSSWFLANLENIEVIKLISQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 66 - protein, 347 aa, Artificial Sequence; 		;
  Artificial SDPS
MHHHHHHAATIPDATTTSVTERTSVSSLLEVVSEDLLSLNNNLKSLVGAENPVLVSVAEQIFGAGGKRLRPALVFLVSRATAELAGLSELTAEHRRLAEIIEMIHTASLIHDDVIDDSGMRRGKETIHQLYGTRVAVLAGDFMFAQSSWFLANLENIEVIKLISQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 67 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIDGAGGKRLRPALVFLVSRATAELAGLSELTAEHRRLAEIIEMIHTASLIHDDVIDDSGMRRGKETIHQLYGTRVAVLAGDFMFAQSSWFLANLENIEVIKLISQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 68 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIKGAGGKRLRPALVFLVSRATAELAGLSELTAEHRRLAEIIEMIHTASLIHDDVIDDSGMRRGKETIHQLYGTRVAVLAGDFMFAQSSWFLANLENIEVIKLISQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 69 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQINGAGGKRLRPALVFLVSRATAELAGLSELTAEHRRLAEIIEMIHTASLIHDDVIDDSGMRRGKETIHQLYGTRVAVLAGDFMFAQSSWFLANLENIEVIKLISQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 70 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIRGAGGKRLRPALVFLVSRATAELAGLSELTAEHRRLAEIIEMIHTASLIHDDVIDDSGMRRGKETIHQLYGTRVAVLAGDFMFAQSSWFLANLENIEVIKLISQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 71 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQITGAGGKRLRPALVFLVSRATAELAGLSELTAEHRRLAEIIEMIHTASLIHDDVIDDSGMRRGKETIHQLYGTRVAVLAGDFMFAQSSWFLANLENIEVIKLISQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 72 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRIALVFLVSRATAELAGLSELTAEHRRLAEIIEMIHTASLIHDDVIDDSGMRRGKETIHQLYGTRVAVLAGDFMFAQSSWFLANLENIEVIKLISQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 73 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRLALVFLVSRATAELAGLSELTAEHRRLAEIIEMIHTASLIHDDVIDDSGMRRGKETIHQLYGTRVAVLAGDFMFAQSSWFLANLENIEVIKLISQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 74 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRMALVFLVSRATAELAGLSELTAEHRRLAEIIEMIHTASLIHDDVIDDSGMRRGKETIHQLYGTRVAVLAGDFMFAQSSWFLANLENIEVIKLISQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 75 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRTALVFLVSRATAELAGLSELTAEHRRLAEIIEMIHTASLIHDDVIDDSGMRRGKETIHQLYGTRVAVLAGDFMFAQSSWFLANLENIEVIKLISQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 76 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRVALVFLVSRATAELAGLSELTAEHRRLAEIIEMIHTASLIHDDVIDDSGMRRGKETIHQLYGTRVAVLAGDFMFAQSSWFLANLENIEVIKLISQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 77 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALEFLVSRATAELAGLSELTAEHRRLAEIIEMIHTASLIHDDVIDDSGMRRGKETIHQLYGTRVAVLAGDFMFAQSSWFLANLENIEVIKLISQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 78 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALFFLVSRATAELAGLSELTAEHRRLAEIIEMIHTASLIHDDVIDDSGMRRGKETIHQLYGTRVAVLAGDFMFAQSSWFLANLENIEVIKLISQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 79 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALIFLVSRATAELAGLSELTAEHRRLAEIIEMIHTASLIHDDVIDDSGMRRGKETIHQLYGTRVAVLAGDFMFAQSSWFLANLENIEVIKLISQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 80 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALMFLVSRATAELAGLSELTAEHRRLAEIIEMIHTASLIHDDVIDDSGMRRGKETIHQLYGTRVAVLAGDFMFAQSSWFLANLENIEVIKLISQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 81 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALNFLVSRATAELAGLSELTAEHRRLAEIIEMIHTASLIHDDVIDDSGMRRGKETIHQLYGTRVAVLAGDFMFAQSSWFLANLENIEVIKLISQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 82 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRFAEIIEMIHTASLIHDDVIDDSGMRRGKETIHQLYGTRVAVLAGDFMFAQSSWFLANLENIEVIKLISQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 83 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRTAEIIEMIHTASLIHDDVIDDSGMRRGKETIHQLYGTRVAVLAGDFMFAQSSWFLANLENIEVIKLISQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 84 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLIEIIEMIHTASLIHDDVIDDSGMRRGKETIHQLYGTRVAVLAGDFMFAQSSWFLANLENIEVIKLISQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 85 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLPEIIEMIHTASLIHDDVIDDSGMRRGKETIHQLYGTRVAVLAGDFMFAQSSWFLANLENIEVIKLISQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 86 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLSEIIEMIHTASLIHDDVIDDSGMRRGKETIHQLYGTRVAVLAGDFMFAQSSWFLANLENIEVIKLISQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 87 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAAIIEMIHTASLIHDDVIDDSGMRRGKETIHQLYGTRVAVLAGDFMFAQSSWFLANLENIEVIKLISQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 88 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLADIIEMIHTASLIHDDVIDDSGMRRGKETIHQLYGTRVAVLAGDFMFAQSSWFLANLENIEVIKLISQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 89 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAHIIEMIHTASLIHDDVIDDSGMRRGKETIHQLYGTRVAVLAGDFMFAQSSWFLANLENIEVIKLISQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 90 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAKIIEMIHTASLIHDDVIDDSGMRRGKETIHQLYGTRVAVLAGDFMFAQSSWFLANLENIEVIKLISQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 91 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLANIIEMIHTASLIHDDVIDDSGMRRGKETIHQLYGTRVAVLAGDFMFAQSSWFLANLENIEVIKLISQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 92 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAPIIEMIHTASLIHDDVIDDSGMRRGKETIHQLYGTRVAVLAGDFMFAQSSWFLANLENIEVIKLISQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 93 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAYIIEMIHTASLIHDDVIDDSGMRRGKETIHQLYGTRVAVLAGDFMFAQSSWFLANLENIEVIKLISQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 94 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEAIEMIHTASLIHDDVIDDSGMRRGKETIHQLYGTRVAVLAGDFMFAQSSWFLANLENIEVIKLISQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 95 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAECIEMIHTASLIHDDVIDDSGMRRGKETIHQLYGTRVAVLAGDFMFAQSSWFLANLENIEVIKLISQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 96 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEFIEMIHTASLIHDDVIDDSGMRRGKETIHQLYGTRVAVLAGDFMFAQSSWFLANLENIEVIKLISQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 97 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAELIEMIHTASLIHDDVIDDSGMRRGKETIHQLYGTRVAVLAGDFMFAQSSWFLANLENIEVIKLISQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 98 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEMIEMIHTASLIHDDVIDDSGMRRGKETIHQLYGTRVAVLAGDFMFAQSSWFLANLENIEVIKLISQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 99 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAESIEMIHTASLIHDDVIDDSGMRRGKETIHQLYGTRVAVLAGDFMFAQSSWFLANLENIEVIKLISQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 100 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAETIEMIHTASLIHDDVIDDSGMRRGKETIHQLYGTRVAVLAGDFMFAQSSWFLANLENIEVIKLISQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 101 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEYIEMIHTASLIHDDVIDDSGMRRGKETIHQLYGTRVAVLAGDFMFAQSSWFLANLENIEVIKLISQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 102 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIGEMIHTASLIHDDVIDDSGMRRGKETIHQLYGTRVAVLAGDFMFAQSSWFLANLENIEVIKLISQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 103 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIQEMIHTASLIHDDVIDDSGMRRGKETIHQLYGTRVAVLAGDFMFAQSSWFLANLENIEVIKLISQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 104 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIWEMIHTASLIHDDVIDDSGMRRGKETIHQLYGTRVAVLAGDFMFAQSSWFLANLENIEVIKLISQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 105 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIIMIHTASLIHDDVIDDSGMRRGKETIHQLYGTRVAVLAGDFMFAQSSWFLANLENIEVIKLISQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 106 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEIIHTASLIHDDVIDDSGMRRGKETIHQLYGTRVAVLAGDFMFAQSSWFLANLENIEVIKLISQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 107 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEQIHTASLIHDDVIDDSGMRRGKETIHQLYGTRVAVLAGDFMFAQSSWFLANLENIEVIKLISQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 108 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIESIHTASLIHDDVIDDSGMRRGKETIHQLYGTRVAVLAGDFMFAQSSWFLANLENIEVIKLISQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 109 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEYIHTASLIHDDVIDDSGMRRGKETIHQLYGTRVAVLAGDFMFAQSSWFLANLENIEVIKLISQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 110 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEWIHTASLIHDDVIDDSGMRRGKETIHQLYGTRVAVLAGDFMFAQSSWFLANLENIEVIKLISQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 111 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMMHTASLIHDDVIDDSGMRRGKETIHQLYGTRVAVLAGDFMFAQSSWFLANLENIEVIKLISQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 112 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMNHTASLIHDDVIDDSGMRRGKETIHQLYGTRVAVLAGDFMFAQSSWFLANLENIEVIKLISQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 113 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTGSLIHDDVIDDSGMRRGKETIHQLYGTRVAVLAGDFMFAQSSWFLANLENIEVIKLISQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 114 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTSSLIHDDVIDDSGMRRGKETIHQLYGTRVAVLAGDFMFAQSSWFLANLENIEVIKLISQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 115 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTTSLIHDDVIDDSGMRRGKETIHQLYGTRVAVLAGDFMFAQSSWFLANLENIEVIKLISQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 116 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHCASLIHDDVIDDSGMRRGKETIHQLYGTRVAVLAGDFMFAQSSWFLANLENIEVIKLISQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 117 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHQASLIHDDVIDDSGMRRGKETIHQLYGTRVAVLAGDFMFAQSSWFLANLENIEVIKLISQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 118 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTAALIHDDVIDDSGMRRGKETIHQLYGTRVAVLAGDFMFAQSSWFLANLENIEVIKLISQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 119 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTATLIHDDVIDDSGMRRGKETIHQLYGTRVAVLAGDFMFAQSSWFLANLENIEVIKLISQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 120 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTAGLIHDDVIDDSGMRRGKETIHQLYGTRVAVLAGDFMFAQSSWFLANLENIEVIKLISQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 121 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLEHDDVIDDSGMRRGKETIHQLYGTRVAVLAGDFMFAQSSWFLANLENIEVIKLISQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 122 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLFHDDVIDDSGMRRGKETIHQLYGTRVAVLAGDFMFAQSSWFLANLENIEVIKLISQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 123 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLTHDDVIDDSGMRRGKETIHQLYGTRVAVLAGDFMFAQSSWFLANLENIEVIKLISQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 124 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLVHDDVIDDSGMRRGKETIHQLYGTRVAVLAGDFMFAQSSWFLANLENIEVIKLISQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 125 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIFDDVIDDSGMRRGKETIHQLYGTRVAVLAGDFMFAQSSWFLANLENIEVIKLISQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 126 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIIDDVIDDSGMRRGKETIHQLYGTRVAVLAGDFMFAQSSWFLANLENIEVIKLISQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 127 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLILDDVIDDSGMRRGKETIHQLYGTRVAVLAGDFMFAQSSWFLANLENIEVIKLISQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 128 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIMDDVIDDSGMRRGKETIHQLYGTRVAVLAGDFMFAQSSWFLANLENIEVIKLISQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 129 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIVDDVIDDSGMRRGKETIHQLYGTRVAVLAGDFMFAQSSWFLANLENIEVIKLISQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 130 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDAIDDSGMRRGKETIHQLYGTRVAVLAGDFMFAQSSWFLANLENIEVIKLISQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 131 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDTIDDSGMRRGKETIHQLYGTRVAVLAGDFMFAQSSWFLANLENIEVIKLISQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 132 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETAHQLYGTRVAVLAGDFMFAQSSWFLANLENIEVIKLISQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 133 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETFHQLYGTRVAVLAGDFMFAQSSWFLANLENIEVIKLISQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 134 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETGHQLYGTRVAVLAGDFMFAQSSWFLANLENIEVIKLISQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 135 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETHHQLYGTRVAVLAGDFMFAQSSWFLANLENIEVIKLISQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 136 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETKHQLYGTRVAVLAGDFMFAQSSWFLANLENIEVIKLISQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 137 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETQHQLYGTRVAVLAGDFMFAQSSWFLANLENIEVIKLISQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 138 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETRHQLYGTRVAVLAGDFMFAQSSWFLANLENIEVIKLISQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 139 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETSHQLYGTRVAVLAGDFMFAQSSWFLANLENIEVIKLISQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 140 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETTHQLYGTRVAVLAGDFMFAQSSWFLANLENIEVIKLISQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 141 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLAGTRVAVLAGDFMFAQSSWFLANLENIEVIKLISQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 142 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLDGTRVAVLAGDFMFAQSSWFLANLENIEVIKLISQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 143 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLEGTRVAVLAGDFMFAQSSWFLANLENIEVIKLISQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 144 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLHGTRVAVLAGDFMFAQSSWFLANLENIEVIKLISQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 145 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLIGTRVAVLAGDFMFAQSSWFLANLENIEVIKLISQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 146 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLKGTRVAVLAGDFMFAQSSWFLANLENIEVIKLISQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 147 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLLGTRVAVLAGDFMFAQSSWFLANLENIEVIKLISQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 148 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLMGTRVAVLAGDFMFAQSSWFLANLENIEVIKLISQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 149 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLNGTRVAVLAGDFMFAQSSWFLANLENIEVIKLISQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 150 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLQGTRVAVLAGDFMFAQSSWFLANLENIEVIKLISQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 151 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLRGTRVAVLAGDFMFAQSSWFLANLENIEVIKLISQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 152 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLSGTRVAVLAGDFMFAQSSWFLANLENIEVIKLISQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 153 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLTGTRVAVLAGDFMFAQSSWFLANLENIEVIKLISQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 154 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLVGTRVAVLAGDFMFAQSSWFLANLENIEVIKLISQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 155 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLYNTRVAVLAGDFMFAQSSWFLANLENIEVIKLISQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 156 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLYGYRVAVLAGDFMFAQSSWFLANLENIEVIKLISQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 157 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLYGTDVAVLAGDFMFAQSSWFLANLENIEVIKLISQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 158 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLYGTEVAVLAGDFMFAQSSWFLANLENIEVIKLISQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 159 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLYGTNVAVLAGDFMFAQSSWFLANLENIEVIKLISQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 160 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLYGTTVAVLAGDFMFAQSSWFLANLENIEVIKLISQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 161 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLYGTVVAVLAGDFMFAQSSWFLANLENIEVIKLISQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 162 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLYGTRVAVIAGDFMFAQSSWFLANLENIEVIKLISQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 163 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLYGTRVAVMAGDFMFAQSSWFLANLENIEVIKLISQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 164 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLYGTRVAVLTGDFMFAQSSWFLANLENIEVIKLISQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 165 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLYGTRVAVLAGDAMFAQSSWFLANLENIEVIKLISQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 166 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLYGTRVAVLAGDFIFAQSSWFLANLENIEVIKLISQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 167 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLYGTRVAVLAGDFCFAQSSWFLANLENIEVIKLISQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 168 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLYGTRVAVLAGDFMWAQSSWFLANLENIEVIKLISQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 169 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLYGTRVAVLAGDFMFGQSSWFLANLENIEVIKLISQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 170 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLYGTRVAVLAGDFMFMQSSWFLANLENIEVIKLISQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 171 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLYGTRVAVLAGDFMFSQSSWFLANLENIEVIKLISQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 172 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLYGTRVAVLAGDFMFAASSWFLANLENIEVIKLISQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 173 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLYGTRVAVLAGDFMFAESSWFLANLENIEVIKLISQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 174 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLYGTRVAVLAGDFMFAFSSWFLANLENIEVIKLISQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 175 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLYGTRVAVLAGDFMFAGSSWFLANLENIEVIKLISQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 176 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLYGTRVAVLAGDFMFAHSSWFLANLENIEVIKLISQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 177 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLYGTRVAVLAGDFMFAISSWFLANLENIEVIKLISQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 178 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLYGTRVAVLAGDFMFAKSSWFLANLENIEVIKLISQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 179 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLYGTRVAVLAGDFMFALSSWFLANLENIEVIKLISQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 180 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLYGTRVAVLAGDFMFAMSSWFLANLENIEVIKLISQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 181 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLYGTRVAVLAGDFMFARSSWFLANLENIEVIKLISQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 182 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLYGTRVAVLAGDFMFAYSSWFLANLENIEVIKLISQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 183 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLYGTRVAVLAGDFMFAQFSWFLANLENIEVIKLISQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 184 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLYGTRVAVLAGDFMFAQISWFLANLENIEVIKLISQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 185 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLYGTRVAVLAGDFMFAQMSWFLANLENIEVIKLISQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 186 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLYGTRVAVLAGDFMFAQNSWFLANLENIEVIKLISQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 187 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLYGTRVAVLAGDFMFAQQSWFLANLENIEVIKLISQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 188 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLYGTRVAVLAGDFMFAQTSWFLANLENIEVIKLISQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 189 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLYGTRVAVLAGDFMFAQVSWFLANLENIEVIKLISQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 190 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLYGTRVAVLAGDFMFAQSCWFLANLENIEVIKLISQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 191 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLYGTRVAVLAGDFMFAQSFWFLANLENIEVIKLISQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 192 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLYGTRVAVLAGDFMFAQSHWFLANLENIEVIKLISQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 193 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLYGTRVAVLAGDFMFAQSIWFLANLENIEVIKLISQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 194 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLYGTRVAVLAGDFMFAQSKWFLANLENIEVIKLISQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 195 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLYGTRVAVLAGDFMFAQSMWFLANLENIEVIKLISQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 196 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLYGTRVAVLAGDFMFAQSNWFLANLENIEVIKLISQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 197 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLYGTRVAVLAGDFMFAQSQWFLANLENIEVIKLISQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 198 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLYGTRVAVLAGDFMFAQSTWFLANLENIEVIKLISQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 199 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLYGTRVAVLAGDFMFAQSVWFLANLENIEVIKLISQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 200 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLYGTRVAVLAGDFMFAQSYWFLANLENIEVIKLISQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 201 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLYGTRVAVLAGDFMFAQSSAFLANLENIEVIKLISQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 202 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLYGTRVAVLAGDFMFAQSSCFLANLENIEVIKLISQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 203 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLYGTRVAVLAGDFMFAQSSEFLANLENIEVIKLISQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 204 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLYGTRVAVLAGDFMFAQSSIFLANLENIEVIKLISQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 205 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLYGTRVAVLAGDFMFAQSSLFLANLENIEVIKLISQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 206 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLYGTRVAVLAGDFMFAQSSQFLANLENIEVIKLISQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 207 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLYGTRVAVLAGDFMFAQSSRFLANLENIEVIKLISQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 208 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLYGTRVAVLAGDFMFAQSSTFLANLENIEVIKLISQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 209 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLYGTRVAVLAGDFMFAQSSVFLANLENIEVIKLISQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 210 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLYGTRVAVLAGDFMFAQSSWDLANLENIEVIKLISQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 211 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLYGTRVAVLAGDFMFAQSSWLLANLENIEVIKLISQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 212 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLYGTRVAVLAGDFMFAQSSWMLANLENIEVIKLISQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 213 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLYGTRVAVLAGDFMFAQSSWRLANLENIEVIKLISQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 214 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLYGTRVAVLAGDFMFAQSSWVLANLENIEVIKLISQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 215 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLYGTRVAVLAGDFMFAQSSWWLANLENIEVIKLISQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 216 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLYGTRVAVLAGDFMFAQSSWFCANLENIEVIKLISQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 217 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLYGTRVAVLAGDFMFAQSSWFIANLENIEVIKLISQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 218 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLYGTRVAVLAGDFMFAQSSWFMANLENIEVIKLISQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 219 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLYGTRVAVLAGDFMFAQSSWFTANLENIEVIKLISQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 220 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLYGTRVAVLAGDFMFAQSSWFVANLENIEVIKLISQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 221 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLYGTRVAVLAGDFMFAQSSWFLHNLENIEVIKLISQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 222 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLYGTRVAVLAGDFMFAQSSWFLINLENIEVIKLISQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 223 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLYGTRVAVLAGDFMFAQSSWFLLNLENIEVIKLISQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 224 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLYGTRVAVLAGDFMFAQSSWFLMNLENIEVIKLISQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 225 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLYGTRVAVLAGDFMFAQSSWFLNNLENIEVIKLISQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 226 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLYGTRVAVLAGDFMFAQSSWFLTNLENIEVIKLISQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 227 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLYGTRVAVLAGDFMFAQSSWFLAELENIEVIKLISQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 228 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLYGTRVAVLAGDFMFAQSSWFLARLENIEVIKLISQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 229 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLYGTRVAVLAGDFMFAQSSWFLANLENIGVIKLISQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 230 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLYGTRVAVLAGDFMFAQSSWFLANLENIEVIGLISQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 231 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLYGTRVAVLAGDFMFAQSSWFLANLENIEVINLISQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 232 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLYGTRVAVLAGDFMFAQSSWFLANLENIEVISLISQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 233 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLYGTRVAVLAGDFMFAQSSWFLANLENIEVIKAISQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 234 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLYGTRVAVLAGDFMFAQSSWFLANLENIEVIKRISQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 235 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLYGTRVAVLAGDFMFAQSSWFLANLENIEVIKLASQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 236 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLYGTRVAVLAGDFMFAQSSWFLANLENIEVIKLCSQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 237 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLYGTRVAVLAGDFMFAQSSWFLANLENIEVIKLWSQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 238 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLYGTRVAVLAGDFMFAQSSWFLANLENIEVIKLIAQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 239 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLYGTRVAVLAGDFMFAQSSWFLANLENIEVIKLIHQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 240 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLYGTRVAVLAGDFMFAQSSWFLANLENIEVIKLINQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 241 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLYGTRVAVLAGDFMFAQSSWFLANLENIEVIKLITQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 242 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLYGTRVAVLAGDFMFAQSSWFLANLENIEVIKLISQAIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 243 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLYGTRVAVLAGDFMFAQSSWFLANLENIEVIKLISQGIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 244 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLYGTRVAVLAGDFMFAQSSWFLANLENIEVIKLISQNIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 245 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLYGTRVAVLAGDFMFAQSSWFLANLENIEVIKLISQQIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 246 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLYGTRVAVLAGDFMFAQSSWFLANLENIEVIKLISQSIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 247 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLYGTRVAVLAGDFMFAQSSWFLANLENIEVIKLISQVAKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 248 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLYGTRVAVLAGDFMFAQSSWFLANLENIEVIKLISQVFKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 249 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLYGTRVAVLAGDFMFAQSSWFLANLENIEVIKLISQVGKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 250 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLYGTRVAVLAGDFMFAQSSWFLANLENIEVIKLISQVHKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 251 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLYGTRVAVLAGDFMFAQSSWFLANLENIEVIKLISQVKKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 252 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLYGTRVAVLAGDFMFAQSSWFLANLENIEVIKLISQVLKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 253 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLYGTRVAVLAGDFMFAQSSWFLANLENIEVIKLISQVMKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 254 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLYGTRVAVLAGDFMFAQSSWFLANLENIEVIKLISQVNKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 255 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLYGTRVAVLAGDFMFAQSSWFLANLENIEVIKLISQVPKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 256 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLYGTRVAVLAGDFMFAQSSWFLANLENIEVIKLISQVQKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 257 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLYGTRVAVLAGDFMFAQSSWFLANLENIEVIKLISQVSKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 258 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLYGTRVAVLAGDFMFAQSSWFLANLENIEVIKLISQVVKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 259 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLYGTRVAVLAGDFMFAQSSWFLANLENIEVIKLISQVYKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 260 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLYGTRVAVLAGDFMFAQSSWFLANLENIEVIKLISQVIFDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 261 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLYGTRVAVLAGDFMFAQSSWFLANLENIEVIKLISQVIHDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 262 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLYGTRVAVLAGDFMFAQSSWFLANLENIEVIKLISQVIMDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 263 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLYGTRVAVLAGDFMFAQSSWFLANLENIEVIKLISQVINDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 264 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLYGTRVAVLAGDFMFAQSSWFLANLENIEVIKLISQVIWDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 265 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLYGTRVAVLAGDFMFAQSSWFLANLENIEVIKLISQVIKEFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 266 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLYGTRVAVLAGDFMFAQSSWFLANLENIEVIKLISQVIKMFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 267 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLYGTRVAVLAGDFMFAQSSWFLANLENIEVIKLISQVIKNFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 268 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLYGTRVAVLAGDFMFAQSSWFLANLENIEVIKLISQVIKQFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 269 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLYGTRVAVLAGDFMFAQSSWFLANLENIEVIKLISQVIKSFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 270 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLYGTRVAVLAGDFMFAQSSWFLANLENIEVIKLISQVIKTFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 271 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLYGTRVAVLAGDFMFAQSSWFLANLENIEVIKLISQVIKYFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 272 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLYGTRVAVLAGDFMFAQSSWFLANLENIEVIKLISQVIKDEASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 273 - protein, 347 aa, Artificial Sequence; 		;; identical to SEQ ID NO: 18
  Artificial SDPS

SEQ ID NO: 274 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLYGTRVAVLAGDFMFAQSSWFLANLENIEVIKLISQVIKDMASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 275 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLYGTRVAVLAGDFMFAQSSWFLANLENIEVIKLISQVIKDNASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 276 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLYGTRVAVLAGDFMFAQSSWFLANLENIEVIKLISQVIKDVASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 277 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLYGTRVAVLAGDFMFAQSSWFLANLENIEVIKLISQVIKDFPSGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 278 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLYGTRVAVLAGDFMFAQSSWFLANLENIEVIKLISQVIKDFAAGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 279 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLYGTRVAVLAGDFMFAQSSWFLANLENIEVIKLISQVIKDFAEGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 280 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLYGTRVAVLAGDFMFAQSSWFLANLENIEVIKLISQVIKDFAFGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 281 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLYGTRVAVLAGDFMFAQSSWFLANLENIEVIKLISQVIKDFAGGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 282 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLYGTRVAVLAGDFMFAQSSWFLANLENIEVIKLISQVIKDFAKGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 283 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLYGTRVAVLAGDFMFAQSSWFLANLENIEVIKLISQVIKDFALGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 284 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLYGTRVAVLAGDFMFAQSSWFLANLENIEVIKLISQVIKDFANGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 285 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLYGTRVAVLAGDFMFAQSSWFLANLENIEVIKLISQVIKDFAQGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 286 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLYGTRVAVLAGDFMFAQSSWFLANLENIEVIKLISQVIKDFATGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 287 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLYGTRVAVLAGDFMFAQSSWFLANLENIEVIKLISQVIKDFAVGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 288 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLYGTRVAVLAGDFMFAQSSWFLANLENIEVIKLISQVIKDFAYGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 289 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLYGTRVAVLAGDFMFAQSSWFLANLENIEVIKLISQVIKDFASAEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 290 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLYGTRVAVLAGDFMFAQSSWFLANLENIEVIKLISQVIKDFASGELKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 291 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLYGTRVAVLAGDFMFAQSSWFLANLENIEVIKLISQVIKDFASGEMKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 292 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLYGTRVAVLAGDFMFAQSSWFLANLENIEVIKLISQVIKDFASGEVKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 293 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLYGTRVAVLAGDFMFAQSSWFLANLENIEVIKLISQVIKDFASGEILQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 294 - protein, 347 aa, Artificial Sequence; 		;; identical to SEQ ID NO: 16
  Artificial SDPS

SEQ ID NO: 295 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLYGTRVAVLAGDFMFAQSSWFLANLENIEVIKLISQVIKDFASGEIKQWSTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 296 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLYGTRVAVLAGDFMFAQSSWFLANLENIEVIKLISQVIKDFASGEIKQANTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 297 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLYGTRVAVLAGDFMFAQSSWFLANLENIEVIKLISQVIKDFASGEIKQASELFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 298 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLYGTRVAVLAGDFMFAQSSWFLANLENIEVIKLISQVIKDFASGEIKQASGLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 299 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLYGTRVAVLAGDFMFAQSSWFLANLENIEVIKLISQVIKDFASGEIKQASHLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 300 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLYGTRVAVLAGDFMFAQSSWFLANLENIEVIKLISQVIKDFASGEIKQASMLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 301 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLYGTRVAVLAGDFMFAQSSWFLANLENIEVIKLISQVIKDFASGEIKQASQLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 302 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLYGTRVAVLAGDFMFAQSSWFLANLENIEVIKLISQVIKDFASGEIKQASWLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 303 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLYGTRVAVLAGDFMFAQSSWFLANLENIEVIKLISQVIKDFASGEIKQASTLFDCDITLDDYLLKSYDKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 304 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLYGTRVAVLAGDFMFAQSSWFLANLENIEVIKLISQVIKDFASGEIKQASTLFDCDITLDDYLLKSYGKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 305 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLYGTRVAVLAGDFMFAQSSWFLANLENIEVIKLISQVIKDFASGEIKQASTLFDCDITLDDYLLKSYLKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 306 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLYGTRVAVLAGDFMFAQSSWFLANLENIEVIKLISQVIKDFASGEIKQASTLFDCDITLDDYLLKSYMKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 307 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLYGTRVAVLAGDFMFAQSSWFLANLENIEVIKLISQVIKDFASGEIKQASTLFDCDITLDDYLLKSYQKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 308 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLYGTRVAVLAGDFMFAQSSWFLANLENIEVIKLISQVIKDFASGEIKQASTLFDCDITLDDYLLKSYYKSASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 309 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLYGTRVAVLAGDFMFAQSSWFLANLENIEVIKLISQVIKDFASGEIKQASTLFDCDITLDDYLLKSYYKTASFIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 310 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLYGTRVAVLAGDFMFAQSSWFLANLENIEVIKLISQVIKDFASGEIKQASTLFDCDITLDDYLLKSYYKTASLWAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 311 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLYGTRVAVLAGDFMFAQSSWFLANLENIEVIKLISQVIKDFASGEIKQASTLFDCDITLDDYLLKSYYKTASLFAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 312 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLYGTRVAVLAGDFMFAQSSWFLANLENIEVIKLISQVIKDFASGEIKQASTLFDCDITLDDYLLKSYYKTASLIAGSTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 313 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLYGTRVAVLAGDFMFAQSSWFLANLENIEVIKLISQVIKDFASGEIKQASTLFDCDITLDDYLLKSYYKTASLIAHSTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 314 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLYGTRVAVLAGDFMFAQSSWFLANLENIEVIKLISQVIKDFASGEIKQASTLFDCDITLDDYLLKSYYKTASLIAKSTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 315 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLYGTRVAVLAGDFMFAQSSWFLANLENIEVIKLISQVIKDFASGEIKQASTLFDCDITLDDYLLKSYYKTASLIANSTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 316 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLYGTRVAVLAGDFMFAQSSWFLANLENIEVIKLISQVIKDFASGEIKQASTLFDCDITLDDYLLKSYYKTASLIARSTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 317 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLYGTRVAVLAGDFMFAQSSWFLANLENIEVIKLISQVIKDFASGEIKQASTLFDCDITLDDYLLKSYYKTASLIAACTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 318 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLYGTRVAVLAGDFMFAQSSWFLANLENIEVIKLISQVIKDFASGEIKQASTLFDCDITLDDYLLKSYYKTASLIAAFTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 319 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLYGTRVAVLAGDFMFAQSSWFLANLENIEVIKLISQVIKDFASGEIKQASTLFDCDITLDDYLLKSYYKTASLIAAITKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 320 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLYGTRVAVLAGDFMFAQSSWFLANLENIEVIKLISQVIKDFASGEIKQASTLFDCDITLDDYLLKSYYKTASLIAAMTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 321 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLYGTRVAVLAGDFMFAQSSWFLANLENIEVIKLISQVIKDFASGEIKQASTLFDCDITLDDYLLKSYYKTASLIAATTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 322 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLYGTRVAVLAGDFMFAQSSWFLANLENIEVIKLISQVIKDFASGEIKQASTLFDCDITLDDYLLKSYYKTASLIAAWTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 323 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLYGTRVAVLAGDFMFAQSSWFLANLENIEVIKLISQVIKDFASGEIKQASTLFDCDITLDDYLLKSYYKTASLIAASTKSASIFSGVSTTICEKMYAYGFNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 324 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLYGTRVAVLAGDFMFAQSSWFLANLENIEVIKLISQVIKDFASGEIKQASTLFDCDITLDDYLLKSYYKTASLIAASTKSASIFSGVSTTICEKMYAYGHNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 325 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLYGTRVAVLAGDFMFAQSSWFLANLENIEVIKLISQVIKDFASGEIKQASTLFDCDITLDDYLLKSYYKTASLIAASTKSASIFSGVSTTICEKMYAYGLNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 326 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLYGTRVAVLAGDFMFAQSSWFLANLENIEVIKLISQVIKDFASGEIKQASTLFDCDITLDDYLLKSYYKTASLIAASTKSASIFSGVSTTICEKMYAYGNNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 327 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLYGTRVAVLAGDFMFAQSSWFLANLENIEVIKLISQVIKDFASGEIKQASTLFDCDITLDDYLLKSYYKTASLIAASTKSASIFSGVSTTICEKMYAYGRNLGGSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 328 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLYGTRVAVLAGDFMFAQSSWFLANLENIEVIKLISQVIKDFASGEIKQASTLFDCDITLDDYLLKSYYKTASLIAASTKSASIFSGVSTTICEKMYAYGRNLALSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 329 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLYGTRVAVLAGDFMFAQSSWFLANLENIEVIKLISQVIKDFASGEIKQASTLFDCDITLDDYLLKSYYKTASLIAASTKSASIFSGVSTTICEKMYAYGRNLFLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 330 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLYGTRVAVLAGDFMFAQSSWFLANLENIEVIKLISQVIKDFASGEIKQASTLFDCDITLDDYLLKSYYKTASLIAASTKSASIFSGVSTTICEKMYAYGRNLMLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 331 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLYGTRVAVLAGDFMFAQSSWFLANLENIEVIKLISQVIKDFASGEIKQASTLFDCDITLDDYLLKSYYKTASLIAASTKSASIFSGVSTTICEKMYAYGRNLSLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 332 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLYGTRVAVLAGDFMFAQSSWFLANLENIEVIKLISQVIKDFASGEIKQASTLFDCDITLDDYLLKSYYKTASLIAASTKSASIFSGVSTTICEKMYAYGRNLGDSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 333 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLYGTRVAVLAGDFMFAQSSWFLANLENIEVIKLISQVIKDFASGEIKQASTLFDCDITLDDYLLKSYYKTASLIAASTKSASIFSGVSTTICEKMYAYGRNLGESFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 334 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLYGTRVAVLAGDFMFAQSSWFLANLENIEVIKLISQVIKDFASGEIKQASTLFDCDITLDDYLLKSYYKTASLIAASTKSASIFSGVSTTICEKMYAYGRNLGFSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 335 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLYGTRVAVLAGDFMFAQSSWFLANLENIEVIKLISQVIKDFASGEIKQASTLFDCDITLDDYLLKSYYKTASLIAASTKSASIFSGVSTTICEKMYAYGRNLGHSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 336 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLYGTRVAVLAGDFMFAQSSWFLANLENIEVIKLISQVIKDFASGEIKQASTLFDCDITLDDYLLKSYYKTASLIAASTKSASIFSGVSTTICEKMYAYGRNLGNSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 337 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLYGTRVAVLAGDFMFAQSSWFLANLENIEVIKLISQVIKDFASGEIKQASTLFDCDITLDDYLLKSYYKTASLIAASTKSASIFSGVSTTICEKMYAYGRNLGQSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 338 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLYGTRVAVLAGDFMFAQSSWFLANLENIEVIKLISQVIKDFASGEIKQASTLFDCDITLDDYLLKSYYKTASLIAASTKSASIFSGVSTTICEKMYAYGRNLGWSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 339 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLYGTRVAVLAGDFMFAQSSWFLANLENIEVIKLISQVIKDFASGEIKQASTLFDCDITLDDYLLKSYYKTASLIAASTKSASIFSGVSTTICEKMYAYGRNLGYSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 340 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLYGTRVAVLAGDFMFAQSSWFLANLENIEVIKLISQVIKDFASGEIKQASTLFDCDITLDDYLLKSYYKTASLIAASTKSASIFSGVSTTICEKMYAYGRNLGLSCQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 341 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLYGTRVAVLAGDFMFAQSSWFLANLENIEVIKLISQVIKDFASGEIKQASTLFDCDITLDDYLLKSYYKTASLIAASTKSASIFSGVSTTICEKMYAYGRNLGLSIQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 342 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLYGTRVAVLAGDFMFAQSSWFLANLENIEVIKLISQVIKDFASGEIKQASTLFDCDITLDDYLLKSYYKTASLIAASTKSASIFSGVSTTICEKMYAYGRNLGLSLQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 343 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLYGTRVAVLAGDFMFAQSSWFLANLENIEVIKLISQVIKDFASGEIKQASTLFDCDITLDDYLLKSYYKTASLIAASTKSASIFSGVSTTICEKMYAYGRNLGLSMQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 344 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLYGTRVAVLAGDFMFAQSSWFLANLENIEVIKLISQVIKDFASGEIKQASTLFDCDITLDDYLLKSYYKTASLIAASTKSASIFSGVSTTICEKMYAYGRNLGLSVQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 345 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLYGTRVAVLAGDFMFAQSSWFLANLENIEVIKLISQVIKDFASGEIKQASTLFDCDITLDDYLLKSYYKTASLIAASTKSASIFSGVSTTICEKMYAYGRNLGLSFAVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 346 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLYGTRVAVLAGDFMFAQSSWFLANLENIEVIKLISQVIKDFASGEIKQASTLFDCDITLDDYLLKSYYKTASLIAASTKSASIFSGVSTTICEKMYAYGRNLGLSFCVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 347 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLYGTRVAVLAGDFMFAQSSWFLANLENIEVIKLISQVIKDFASGEIKQASTLFDCDITLDDYLLKSYYKTASLIAASTKSASIFSGVSTTICEKMYAYGRNLGLSFDVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 348 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLYGTRVAVLAGDFMFAQSSWFLANLENIEVIKLISQVIKDFASGEIKQASTLFDCDITLDDYLLKSYYKTASLIAASTKSASIFSGVSTTICEKMYAYGRNLGLSFSVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 349 - protein, 347 aa, Artificial Sequence; 		;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTASLIHDDVIDDSGMRRGKETIHQLYGTRVAVLAGDFMFAQSSWFLANLENIEVIKLISQVIKDFASGEIKQASTLFDCDITLDDYLLKSYYKTASLIAASTKSASIFSGVSTTICEKMYAYGRNLGLSFTVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 350 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatgctaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 351 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatagaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 352 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaattggaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 353 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctgctgtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 354 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtcttgcgtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 355 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctgatgtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 356 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctaacgtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 357 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctagcgtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 358 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtcttgggtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 359 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgctaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 360 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccggtaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 361 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccaagaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 362 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgcctacaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 363 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaactgcccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 364 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaacctcccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 365 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgatctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 366 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccaagctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 367 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttgctgtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 368 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttgaggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 369 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttatggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 370 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttcctgtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 371 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgtggcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 372 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattgatggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 373 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattaagggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 374 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattaacggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 375 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattagaggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 376 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattaccggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 377 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtatcgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 378 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtctggctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 379 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtatggctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 380 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtaccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 381 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtgtggctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 382 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagagtttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 383 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttattctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 384 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttaatctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 385 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttaatgtttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 386 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttaaactttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 387 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtttcgcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 388 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtaccgcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 389 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctgatcgaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 390 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctgcctgaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 391 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctgagcgaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 392 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagctatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 393 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagatatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 394 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcacacatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 395 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcaaagatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 396 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcaaacatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 397 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcacctatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 398 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcatacatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 399 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaagctattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 400 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaatgcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 401 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaattcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 402 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaactgattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 403 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatgattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 404 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaagcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 405 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaaccattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 406 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaatacattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 407 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcggtgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 408 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatccaggagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 409 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatctgggagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 410 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattatcatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 411 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatcatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 412 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagcagatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 413 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagagcatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 414 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagtacatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 415 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagtggatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 416 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatgcacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 417 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgaaccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 418 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccggttctttaatccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 419 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccagctctttaatccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 420 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccacctctttaatccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 421 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccactgcgcctctttaatccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 422 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccaccaggcctctttaatccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 423 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgccgctttaatccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 424 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgccaccttaatccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 425 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgccggtttaatccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 426 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatcttcgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 427 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatcatcgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 428 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatcctggacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 429 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatcatggacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 430 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatcgtggacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 431 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttagagcatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 432 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttattccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 433 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaacccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 434 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttagtgcatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 435 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgctattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 436 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacaccattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 437 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccgctcatcagctgtatggcacccgtgttgccgtgctggctggtgactttatgttcgcccagagcagctggtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 438 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccttccatcagctgtatggcacccgtgttgccgtgctggctggtgactttatgttcgcccagagcagctggtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 439 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccggtcatcagctgtatggcacccgtgttgccgtgctggctggtgactttatgttcgcccagagcagctggtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 440 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaacccaccatcagctgtatggcacccgtgttgccgtgctggctggtgactttatgttcgcccagagcagctggtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 441 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccaagcatcagctgtatggcacccgtgttgccgtgctggctggtgactttatgttcgcccagagcagctggtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 442 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaacccagcatcagctgtatggcacccgtgttgccgtgctggctggtgactttatgttcgcccagagcagctggtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 443 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccagacatcagctgtatggcacccgtgttgccgtgctggctggtgactttatgttcgcccagagcagctggtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 444 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccagccatcagctgtatggcacccgtgttgccgtgctggctggtgactttatgttcgcccagagcagctggtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 445 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccacccatcagctgtatggcacccgtgttgccgtgctggctggtgactttatgttcgcccagagcagctggtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 446 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctggctggcacccgtgttgccgtgctggctggtgactttatgttcgcccagagcagctggtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 447 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctggatggcacccgtgttgccgtgctggctggtgactttatgttcgcccagagcagctggtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 448 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctggagggcacccgtgttgccgtgctggctggtgactttatgttcgcccagagcagctggtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 449 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgcacggcacccgtgttgccgtgctggctggtgactttatgttcgcccagagcagctggtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 450 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgatcggcacccgtgttgccgtgctggctggtgactttatgttcgcccagagcagctggtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 451 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgaagggcacccgtgttgccgtgctggctggtgactttatgttcgcccagagcagctggtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 452 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgctgggcacccgtgttgccgtgctggctggtgactttatgttcgcccagagcagctggtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 453 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgatgggcacccgtgttgccgtgctggctggtgactttatgttcgcccagagcagctggtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 454 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgaacggcacccgtgttgccgtgctggctggtgactttatgttcgcccagagcagctggtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 455 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgcagggcacccgtgttgccgtgctggctggtgactttatgttcgcccagagcagctggtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 456 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgagaggcacccgtgttgccgtgctggctggtgactttatgttcgcccagagcagctggtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 457 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgagcggcacccgtgttgccgtgctggctggtgactttatgttcgcccagagcagctggtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 458 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgaccggcacccgtgttgccgtgctggctggtgactttatgttcgcccagagcagctggtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 459 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctggtgggcacccgtgttgccgtgctggctggtgactttatgttcgcccagagcagctggtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 460 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtataacacccgtgttgccgtgctggctggtgactttatgttcgcccagagcagctggtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 461 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggctaccgtgttgccgtgctggctggtgactttatgttcgcccagagcagctggtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 462 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcaccgatgttgccgtgctggctggtgactttatgttcgcccagagcagctggtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 463 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcaccgaggttgccgtgctggctggtgactttatgttcgcccagagcagctggtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 464 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcaccaacgttgccgtgctggctggtgactttatgttcgcccagagcagctggtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 465 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcaccaccgttgccgtgctggctggtgactttatgttcgcccagagcagctggtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 466 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcaccgtggttgccgtgctggctggtgactttatgttcgcccagagcagctggtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 467 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgatcgctggtgactttatgttcgcccagagcagctggtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 468 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgatggctggtgactttatgttcgcccagagcagctggtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 469 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctgaccggtgactttatgttcgcccagagcagctggtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 470 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgacgctatgttcgcccagagcagctggtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 471 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatcttcgcccagagcagctggtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 472 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgacttttgcttcgcccagagcagctggtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 473 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgtgggcccagagcagctggtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 474 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcggtcagagcagctggtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 475 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcatgcagagcagctggtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 476 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcagccagagcagctggtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 477 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgccgctagcagctggtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 478 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgccgagagcagctggtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 479 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgccttcagcagctggtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 480 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgccggtagcagctggtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 481 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccacagcagctggtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 482 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgccatcagcagctggtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 483 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgccaagagcagctggtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 484 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgccctgagcagctggtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 485 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgccatgagcagctggtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 486 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgccagaagcagctggtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 487 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcctacagcagctggtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 488 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagttcagctggtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 489 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagatcagctggtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 490 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagatgagctggtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 491 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagaacagctggtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 492 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagcagagctggtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 493 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagaccagctggtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 494 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccaggtgagctggtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 495 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagctgctggtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 496 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcttctggtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 497 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagccactggtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 498 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcatctggtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 499 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcaagtggtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 500 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcatgtggtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 501 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcaactggtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 502 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagccagtggtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 503 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcacctggtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 504 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcgtgtggtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 505 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagctactggtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 506 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagcgcttttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 507 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctgctttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 508 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagcgagtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 509 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagcatctttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 510 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagcctgtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 511 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagccagtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 512 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagcagatttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 513 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagcacctttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 514 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagcgtgtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 515 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctgggatttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 516 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggctgttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 517 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggatgttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 518 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggagattagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 519 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctgggtgttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 520 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtggttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 521 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggttttgcgccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 522 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttatcgccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 523 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttatggccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 524 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttaccgccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 525 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttgtggccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 526 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttttacacaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 527 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttttaatcaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 528 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttttactgaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 529 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttttaatgaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 530 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttttaaacaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 531 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttttaaccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 532 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttttagccgagctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 533 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttttagccagactggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 534 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcggtgttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 535 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattggtttaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 536 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaacttaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 537 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattagcttaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 538 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaagctatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 539 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaaagaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 540 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattagctagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 541 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattatgcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 542 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattatggagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 543 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatcgctcaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 544 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatccaccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 545 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatcaaccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 546 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatcacccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 547 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatcagccaagctattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 548 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatcagccaaggtattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 549 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatcagccaaaacattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 550 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatcagccaacagattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 551 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatcagccaaagcattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 552 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatcagccaagttgctaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 553 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatcagccaagttttcaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 554 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatcagccaagttggtaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 555 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatcagccaagttcacaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 556 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatcagccaagttaagaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 557 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatcagccaagttctgaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 558 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatcagccaagttatgaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 559 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatcagccaagttaacaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 560 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatcagccaagttcctaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 561 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatcagccaagttcagaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 562 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatcagccaagttagcaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 563 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatcagccaagttgtgaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 564 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatcagccaagtttacaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 565 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatcagccaagttattttcgatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 566 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatcagccaagttattcacgatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 567 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatcagccaagttattatggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 568 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatcagccaagttattaacgatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 569 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatcagccaagttatttgggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 570 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatcagccaagttattaaggagttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 571 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatcagccaagttattaagatgttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 572 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatcagccaagttattaagaacttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 573 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatcagccaagttattaagcagttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 574 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatcagccaagttattaagagcttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 575 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatcagccaagttattaagaccttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 576 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatcagccaagttattaagtacttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 577 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatcagccaagttattaaggatgaggccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 578 - DNA, 1044 bp, Artificial Sequence; 		;; identical to SEQ ID NO: 37
  Artificial SDPS

SEQ ID NO: 579 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatcagccaagttattaaggatatggccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 580 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatcagccaagttattaaggataacgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 581 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatcagccaagttattaaggatgtggccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 582 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatcagccaagttattaaggatttccctagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 583 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatcagccaagttattaaggatttcgccgctggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 584 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatcagccaagttattaaggatttcgccgagggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 585 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatcagccaagttattaaggatttcgccttcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 586 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatcagccaagttattaaggatttcgccggtggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 587 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatcagccaagttattaaggatttcgccaagggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 588 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatcagccaagttattaaggatttcgccctgggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 589 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatcagccaagttattaaggatttcgccaacggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 590 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatcagccaagttattaaggatttcgcccagggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 591 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatcagccaagttattaaggatttcgccaccggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 592 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatcagccaagttattaaggatttcgccgtgggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 593 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatcagccaagttattaaggatttcgcctacggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 594 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatcagccaagttattaaggatttcgccagcgctgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 595 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatcagccaagttattaaggatttcgccagcggcgagctgaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 596 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatcagccaagttattaaggatttcgccagcggcgagatgaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 597 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatcagccaagttattaaggatttcgccagcggcgaggtgaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 598 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatcagccaagttattaaggatttcgccagcggcgagatcctgcaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 599 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatcagccaagttattaaggatttcgccagcggcgagatcaaacaaaccagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 600 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatcagccaagttattaaggatttcgccagcggcgagatcaaacaatggagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 601 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatcagccaagttattaaggatttcgccagcggcgagatcaaacaagctaacactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 602 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatcagccaagttattaaggatttcgccagcggcgagatcaaacaagctagcgagttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 603 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatcagccaagttattaaggatttcgccagcggcgagatcaaacaagctagcggtttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 604 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatcagccaagttattaaggatttcgccagcggcgagatcaaacaagctagccacttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 605 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatcagccaagttattaaggatttcgccagcggcgagatcaaacaagctagcatgttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 606 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatcagccaagttattaaggatttcgccagcggcgagatcaaacaagctagccagttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 607 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatcagccaagttattaaggatttcgccagcggcgagatcaaacaagctagctggttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 608 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatcagccaagttattaaggatttcgccagcggcgagatcaaacaagctagcactttatttgactgcgacatcactttagacgactatctgctgaaaagctacgataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 609 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatcagccaagttattaaggatttcgccagcggcgagatcaaacaagctagcactttatttgactgcgacatcactttagacgactatctgctgaaaagctacggtaaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 610 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatcagccaagttattaaggatttcgccagcggcgagatcaaacaagctagcactttatttgactgcgacatcactttagacgactatctgctgaaaagctacctgaaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 611 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatcagccaagttattaaggatttcgccagcggcgagatcaaacaagctagcactttatttgactgcgacatcactttagacgactatctgctgaaaagctacatgaaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 612 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatcagccaagttattaaggatttcgccagcggcgagatcaaacaagctagcactttatttgactgcgacatcactttagacgactatctgctgaaaagctaccagaaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 613 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatcagccaagttattaaggatttcgccagcggcgagatcaaacaagctagcactttatttgactgcgacatcactttagacgactatctgctgaaaagctactataaaagcgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 614 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtttcattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 615 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgtgggcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 616 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgttcgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 617 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcaggtagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 618 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcacacagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 619 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcaaagagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 620 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcaaacagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 621 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcaagaagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 622 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagcctgcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 623 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccttcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 624 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccatcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 625 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccatgaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 626 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccaccaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 627 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagcctggaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 628 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggcttcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 629 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccacaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 630 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggcctgaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 631 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggcaacaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 632 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtggtagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 633 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttagctctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 634 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttattcctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 635 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaatgctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 636 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaagcctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 637 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtgatagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 638 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtgagagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 639 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtttcagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 640 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtcacagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 641 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtaacagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 642 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtcagagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 643 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggttggagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 644 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggttacagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 645 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagttgccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 646 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtatccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 647 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtctgcaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 648 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtatgcaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 649 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtgtgcaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 650 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttcgctgttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 651 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttctgcgttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 652 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttcgatgttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 653 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttcagcgttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 654 - DNA, 1044 bp, Artificial Sequence; 		;
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttcaccgttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 655 - protein, 28 aa, Artificial Sequence;
  SDPS Motif
  MISC_FEATURE (2)..(2): X may be N or K or H or D
  MISC_FEATURE (2)..(2): X may be N or K or H or D
  MISC_FEATURE (4)..(4): L or A or R or W
  MISC_FEATURE (5)..(5): K or Q or R or L
  MISC_FEATURE (6)..(6): N or S
  MISC_FEATURE (7)..(7): L or I or A or C or D or N or S or W
  MISC_FEATURE (8)..(8): I or V
  MISC_FEATURE (10)..(10): A or E or S
  MISC_FEATURE (11)..(11): E or R or A or G or K or Y
  MISC_FEATURE (12)..(12): N or S or P or L
  MISC_FEATURE (14)..(14): V or M or D or K
  MISC_FEATURE (15)..(15): L or A or E or M or P
  MISC_FEATURE (16)..(16): M or V or I
  MISC_FEATURE (17)..(17): A or S
  MISC_FEATURE (19)..(19): A or V
  MISC_FEATURE (20)..(20): E or D
  MISC_FEATURE (23)..(20): F or D or K or N or R or T
  MISC_FEATURE (23)..(23): F or D or K or N or R or T
  MISC_FEATURE (24)..(24): G or S
NXNXXXXXGXXXPXXXXAXXQIXXAGGK

SEQ ID NO: 656 - protein, 10 aa, Artificial Sequence;
  SDPS Motif
  MISC_FEATURE (2)..(2): K or R
  MISC_FEATURE (2)..(2): K or R
  MISC_FEATURE (3)..(3): L or V or M
  MISC_FEATURE (5)..(5): P or I or L or M or T or V
  MISC_FEATURE (6)..(6): A or M or G
  MISC_FEATURE (7)..(7): L or I
  MISC_FEATURE (8)..(8): V or E or F or I or M or N
KXXRXXXXFL

SEQ ID NO: 657 - protein, 22 aa, Artificial Sequence; 	;
  SDPS Motif
  MISC_FEATURE (2)..(2): K or Q or R
  MISC_FEATURE (4)..(4): L or F or T
  MISC_FEATURE (5)..(5): A or G or I or P or S
  MISC_FEATURE (6)..(6): E or A or D or H or K or N or P or Y
  MISC_FEATURE (7)..(7): I or A or C or F or L or M or S or T or Y
  MISC_FEATURE (8)..(8): I or G or Q or W
  MISC_FEATURE (9)..(9): E or I
  MISC_FEATURE (10)..(10): M or I or Q or S or Y or W
  MISC_FEATURE (12)..(12): I or M or N
  MISC_FEATURE (13)..(13): T or C or Q
  MISC_FEATURE (14)..(14): A or G or S or T
  MISC_FEATURE (16)..(16): S or T or G
  MISC_FEATURE (17)..(17): I or E or F or T or V
  MISC_FEATURE (20)..(20): H or I or F or M or V or L
  MISC_FEATURE (21)..(21): V or A or T
HXRXXXXXXXHXXXLXXDDXXD

SEQ ID NO: 658 - protein, 20 aa, Artificial Sequence
  SDPS Motif
  MISC_FEATURE (2)..(2): K or R
  MISC_FEATURE (3)..(3): D or E or K or Q
  MISC_FEATURE (5)..(5): I or V or A or F or G or H or K or Q or R or S or T
  MISC_FEATURE (6)..(6): H or N
  MISC_FEATURE (7)..(7): Q or T or E
  MISC_FEATURE (8)..(8): L or M
  MISC_FEATURE (9)..(9): Y or F or A or D or E or H or I or K or L or M or N or Q or R or S or T or V
  MISC_FEATURE (10)..(10): G or N
  MISC_FEATURE (11)..(11): T or Y
  MISC_FEATURE (12)..(12): R or D or E or N or T or V
  MISC_FEATURE (13)..(13): I or V
  MISC_FEATURE (16)..(16): L or I or M
  MISC_FEATURE (17)..(17): A or T
  MISC_FEATURE (20)..(20): F or A
GXXTXXXXXXXXXAVXXGDX

SEQ ID NO: 659 - protein, 13 aa, Artificial Sequence
  SDPS Motif
  MISC_FEATURE (1)..(1): M or I or L or C
  MISC_FEATURE (2)..(2): F or W
  MISC_FEATURE (3)..(3): A or G or M or S
  MISC_FEATURE (4)..(4): Q or A or E or F or G or H or I or K or L or M or R or Y
  MISC_FEATURE (5)..(5): S or A or F or I or M or N or Q or T or V
  MISC_FEATURE (6)..(6): S or C or F or H or I or K or M or N or Q or T or V or Y
  MISC_FEATURE (7)..(7): W or A or C or E or I or L or Q or R or T or V
  MISC_FEATURE (8)..(8): F or Y or L or D  or M or R or V or W
  MISC_FEATURE (9)..(9): L or I or C or M or T or V
  MISC_FEATURE (10)..(10): A or H or I or L or N or M or T
  MISC_FEATURE (11)..(11): N or E or R
XXXXXXXXXXXLE

SEQ ID NO: 660 - protein, 25 aa, Artificial Sequence;
  SDPS Motif
  MISC_FEATURE (2)..(2): I or L
  MISC_FEATURE (3)..(3): E or Q or G
  MISC_FEATURE (6)..(6): K or G or N or S
  MISC_FEATURE (7)..(7): L or A or R,
  MISC_FEATURE (8)..(8): I or A or C or W
  MISC_FEATURE (9)..(9): S or A or H or N or T
  MISC_FEATURE (10)..(10): Q or K
  MISC_FEATURE (11)..(11): V or A or G or N or Q or S
  MISC_FEATURE (12)..(12): I or A or F or G or H or K or L or M or N or P or Q or S or V or Y
  MISC_FEATURE (13)..(13): K or A or F or H or M or N or W
  MISC_FEATURE (14)..(14): D or E or M or N or Q or S or T or Y
  MISC_FEATURE (15)..(15): F or E or L or M or N or V
  MISC_FEATURE (16)..(16): A or P
  MISC_FEATURE (17)..(17): S or N or A or E or F or G or K or L or N or Q or T or V or Y
  MISC_FEATURE (18)..(18): G or A
  MISC_FEATURE (20)..(20): I or L or M or V
  MISC_FEATURE (21)..(21): K or S or L
  MISC_FEATURE (23)..(23): A or Q or T or W
  MISC_FEATURE (24)..(24): S or N
  MISC_FEATURE (25)..(25): S or T or N or E or G or H or M or Q or W
NXXVIXXXXXXXXXXXXXEXXQXXX

SEQ ID NO: 661 - protein, 13 aa, Artificial Sequence;
  SDPS Motif
  MISC_FEATURE (2)..(2): F or Y
  MISC_FEATURE (3)..(3): Y or D or G or L or M or Q
  MISC_FEATURE (5)..(5): T or S
  MISC_FEATURE (8)..(8): L or F
  MISC_FEATURE (9)..(9): L or V or I or F or W
  MISC_FEATURE (11)..(11): A or S or G or H or K or N or R
  MISC_FEATURE (12)..(12): S or C or F or I or M or T or W
  MISC_FEATURE (13)..(13): T or C
SXXKXASXXAXXX

SEQ ID NO: 662 - protein, 11 aa, Artificial Sequence;
  SDPS Motif
  MISC_FEATURE (2)..(2): R or K or F or H or L or N
  MISC_FEATURE (3)..(3): N or H
  MISC_FEATURE (5)..(5): G or A or F or M or S
  MISC_FEATURE (6)..(6): L or D or E or F or G or H or N or Q or W or Y
  MISC_FEATURE (7)..(7): A or S
  MISC_FEATURE (8)..(8): F or C or I or L or M or V
  MISC_FEATURE (9)..(9): Q or A or C or D or S or T
GXXLXXXXXVV

SEQ ID NO: 663 - protein, 347 aa, Artificial Sequence
  Artificial SDPS
MHHHHHHAATIPDATTTSVTERTSVSSLLEVVSEDLLSLNNNLKSLVGAEYPVLVSAAEQIFGAGGKRLRPALVFLVSRATAELAGLSELTAEHRRLAEIIEMIHTASLIHDDVIDDSGMRRGKETIHQLYGTRVAVLAGDFMFAQSSWFLANLENIEVIKLISQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 664 - protein, 347 aa, Artificial Sequence
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHGASLIHDDVIDDSGMRRGKETIHQLYGTRVAVLAGDFMFAQSSWFLANLENIEVIKLISQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 665 - protein, 347 aa, Artificial Sequence;
  Artificial SDPS
MHHHHHHAATIPDATTTSVTERTSVSSLLEVVSEDLLSLNNNLKSLVGAENPVLVSAAEQIFGAGGKRLRPALVFLVSRATAELAGLSELTAEHRRLAEIIEMIHTCSLIHDDVIDDSGMRRGKETIHQLYGTRVAVLAGDFMFAQSSWFLANLENIEVIKLISQVIKDFASGEIKQASTLFDCDITLDDYLLKSYYKTASLIAASTKSASIFSGVSTTICEKMYAYGRNLGLSFQVVDDILDFTQSAEQLGKPAASDLAKGNLTAPVIFALQSEPELREIIDSEFSDTDSLATAIELVHRSGGIRRAHELAREKGDLAIQNLQCLPRSDFRSALEKMVEYNLERIE

SEQ ID NO: 666 - DNA, 1044 bp, Artificial Sequence
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaataccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacaccgcctctttaatccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 667 - DNA, 1044 bp, Artificial Sequence
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacggtgcctctttaatccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

SEQ ID NO: 668 - DNA, 1044 bp, Artificial Sequence
  Artificial SDPS
atgcatcaccaccatcaccatgcagccaccattccggacgccaccaccaccagcgttaccgagcgtaccagcgtgagctctttactggaagttgtgagcgaggatctgctgtctttaaacaacaatttaaagtctttagtgggtgccgaaaaccccgttctggtgagcgccgcagaacagattttcggtgctggtggcaaacgtctgcgtcccgctttagtctttttagtgagtcgtgccaccgcagaactggccggtttaagcgaactgaccgcagaacaccgccgtctggcagaaatcattgagatgatccacacctgctctttaatccatgacgacgtgattgacgatagcggtatgcgtcgcggtaaggaaaccatccatcagctgtatggcacccgtgttgccgtgctggctggtgactttatgttcgcccagagcagctggtttttagccaatctggagaatatcgaagttattaaattaatcagccaagttattaaggatttcgccagcggcgagatcaaacaagctagcactttatttgactgcgacatcactttagacgactatctgctgaaaagctactataaaaccgccagtctgattgcagccagcaccaaaagcgccagcatttttagcggcgtgagcaccaccatttgcgagaagatgtacgcctatggccgcaatttaggtctgagtttccaagttgtggacgacattttagatttcacccagagcgcagaacagctgggcaaaccggcagcaagtgatttagcaaaaggcaatctgacagccccggttattttcgcactgcagagcgaaccggagctgcgcgagatcatcgacagtgagtttagcgacaccgattctttagccaccgccattgaactggtgcatcgtagcggtggcattcgtcgcgcccatgaactggcacgtgaaaaaggcgatttagccattcagaatctgcagtgtttaccgcgcagtgatttccgcagcgctttagaaaaaatggtggaatacaatctggaacgcatcgaataa

The invention claimed is:

1. A recombinant polynucleotide comprising:

a nucleic acid sequence that encodes a modified Solanesyl Diphosphate Synthase (SDPS) comprising SEQ ID NO: 5 with the phenylalanine at amino acid 247 replaced with leucine, operably linked to a plant operable promoter, wherein expression of the modified SDPS in a plant confers the plant with increased tolerance to a Solanesyl Diphosphate Synthase-inhibiting herbicide compared to a control plant not expressing the modified SDPS and expressing a native SDPS.

2. A plant cell comprising a recombinant polynucleotide stably incorporated into the genome of the plant cell, the recombinant polynucleotide comprising a nucleic acid sequence encoding a modified Solanesyl Diphosphate Synthase (SDPS) comprising SEQ ID NO: 5 with the phenylalanine at amino acid 247 replaced with leucine, operably linked to a plant operable promoter, wherein expression of the modified SDPS in said plant cell confers the plant cell with increased tolerance to a Solanesyl Diphosphate Synthase-inhibiting herbicide compared to a control plant cell expressing a native SDPS and not expressing the modified SDPS.

3. The recombinant polynucleotide of claim 1, wherein the plant operable promoter is heterologous to the nucleic acid encoding the SDPS.

4. A vector comprising the recombinant polynucleotide of claim 1.

5. A plant comprising a recombinant polynucleotide stably incorporated into the genome of the plant, the recombinant polynucleotide comprising a nucleic acid sequence encoding a modified Solanesyl Diphosphate Synthase (SDPS) comprising SEQ ID NO: 5 with the phenylalanine at amino acid 247 replaced with leucine, operably linked to a plant operable promoter, wherein expression of the modified SDPS in said plant confers the plant with increased tolerance to a Solanesyl Diphosphate Synthase-inhibiting herbicide compared to a control plant cell not expressing the modified SDPS and expressing a native SDPS.

6. The plant of claim 5, wherein the plant comprises a seed and said recombinant polynucleotide is stably incorporated into said seed.

7. The plant of claim 5, wherein said plant is a monocot.

8. The plant of claim 7, wherein said monocot is corn or wheat.

9. The plant of claim 5, wherein said plant is a dicot.

10. The plant of claim 9, wherein said dicot is soybean, sunflower or cotton.

11. The plant of claim 6, wherein said plant is a monocot.

12. The plant of claim 11, wherein said monocot is corn or wheat.

13. The plant of claim 6, wherein said plant is a dicot.

14. The plant of claim 13, wherein said dicot is soybean, sunflower or cotton.

* * * * *